United States Patent
Frejd et al.

(10) Patent No.: US 10,669,314 B2
(45) Date of Patent: *Jun. 2, 2020

(54) POLYPEPTIDE

(71) Applicant: Affibody AB, Solna (SE)

(72) Inventors: Fredrik Frejd, Stockholm (SE); Elin Gunneriusson, Saltsjöbaden (SE); Ingmarie Höidén-Guthenberg, Kista (SE); Per-Ake Nygren, Ekerö (SE); Susanne Klint, Stockholm (SE); Feifan Yu, Sollentuna (SE)

(73) Assignee: AFFIBODY AB, Solina (SE)

( * ) Notice: Subject to any disclaimer, the term of this patent is extended or adjusted under 35 U.S.C. 154(b) by 0 days.

This patent is subject to a terminal disclaimer.

(21) Appl. No.: 15/317,188

(22) PCT Filed: Jun. 15, 2015

(86) PCT No.: PCT/EP2015/063362
§ 371 (c)(1),
(2) Date: Dec. 8, 2016

(87) PCT Pub. No.: WO2015/189430
PCT Pub. Date: Dec. 17, 2015

(65) Prior Publication Data
US 2017/0114099 A1    Apr. 27, 2017

(30) Foreign Application Priority Data
Jun. 13, 2014 (EP) ..................... 14172331

(51) Int. Cl.
| C07K 14/00 | (2006.01) |
| G01N 33/68 | (2006.01) |
| C07K 14/54 | (2006.01) |
| A61K 38/00 | (2006.01) |

(52) U.S. Cl.
CPC .......... *C07K 14/00* (2013.01); *C07K 14/5412* (2013.01); *G01N 33/6869* (2013.01); *A61K 38/00* (2013.01); *C07K 2319/70* (2013.01); *G01N 2333/5412* (2013.01)

(58) Field of Classification Search
CPC .... A61K 38/00; C07K 14/00; C07K 14/5412; C07K 2319/70; G01N 2333/5412; G01N 33/6869
See application file for complete search history.

(56) References Cited

U.S. PATENT DOCUMENTS 6,830,894 B1 * 12/2004 Blaschuk ............. C07K 14/705
435/7.21

2009/0305962 A1   12/2009 Bakker et al.

FOREIGN PATENT DOCUMENTS

| WO | 9713781       | 4/1997 |
| WO | 2007009018 A2 | 1/2007 |
| WO | 2009077175 A1 | 6/2009 |
| WO | 2011110515 A1 | 9/2011 |
| WO | 2013030362    | 3/2013 |
| WO | 2013083813 A2 | 6/2013 |
| WO | 2013126006 A1 | 8/2013 |
| WO | 2014064237 A1 | 5/2014 |
| WO | 2015189431 A1 | 12/2015 |

OTHER PUBLICATIONS

Stephanie Hennigan, Interleukin-6 inhibitors in the treatment of rheumatoid arthritis, Therapeutics and Clinical Risk Management 2008:4(4) 767-775.*
Mechanism of Carcinogenesis, Section 3, 2008, International agency for research on cancer, pp. 1-37.*
Grimm, S., et al., "Selection and Characterisation of affibody molecules inhibiting the interaction between Ras and Raf in vitro", New Biotechnology, Elsevier BV, NL, vol. 27, No. 6, Dec. 31, 2010, pp. 766-773.
International Search Report for International Application No. PCT/EP2015/063362; International Filing Date Jun. 15, 2015; dated Sep. 25, 2015; 6 pages.
Kobayashi, T. et al., "In Vitro Selection of a Peptide Inhibitor of Human IL-6 Using mRNA Display", Molecular Biotechnlogy, vol. 48, No. 2, published online Dec. 7, 2010, pp. 147-155.
Nygren, P., "Alternative binding proteins: Affibody binding proteins developed from a small three-helix bundle scaffold", FEBS Journal, Wiley-Blackwell Publishing Ltd, GB, vol. 275, No. 11, Jun. 1, 2008, pp. 2668-2676.
Wahlberg E. et al., "An affibody in complex with a target protein: Structure and coupled folding", Proceedings of the National Academy of Sciences, vol. 100, No. 6, Mar. 18, 2003, pp. 3185-3190.
Written Opinion of the International Searching Authority for International Application No. PCT/EP2015/063362; International Filing Date: Jun. 15, 2015; dated Sep. 25, 2009; 7 pages.
Dhillon S., "Intravenous Tocilizumab: A Review of Its Use in Adults with Rheumatoid Arthritis", BioDrugs, vol. 28, No. 1, Feb. 2014, published online Nov. 20, 2013, pp. 75-106.
U.S. Non Final Office Action in U.S. Appl. No. 15/317,633, filed Dec. 9, 2016; dated Aug. 8, 2018; 15 pages.
"AA Amyloidosis", Amyloidosis Foundation http://amloidosis.org/facts/al/ downloaded Jan. 29, 2019; 3 pages.

(Continued)

*Primary Examiner* — Rachael E Bredefeld
*Assistant Examiner* — Erinne R Dabkowski
(74) *Attorney, Agent, or Firm* — Cantor Colburn LLP

(57) ABSTRACT

The present disclosure relates to a class of engineered polypeptides having a binding affinity for interleukin-6, and provides an IL-6 binding polypeptide comprising the sequence $EEX_3X_4AWX_7EIH\ X_{11}\ LPNLX_{16}X_{17}X_{18}QX_{20}X_{21}AFIX_{25}X_{26}LX_{28}X_{29}$. The present disclosure also relates to the use of such an IL-6 binding polypeptide as a therapeutic, prognostic and/or diagnostic agent.

20 Claims, 54 Drawing Sheets

Specification includes a Sequence Listing.

(56) References Cited

OTHER PUBLICATIONS

"Data from Phase 2 Study of Alder Biopharmaceuticals' Anti-IL-6 Antibody Therapeutic, ALD518, Demonstrate Reversal of Anemia in Patients with Advanced Non-Small Cell Lung Cancer", PR Newswire, Dec. 7, 2010, downloaded Feb. 6, 2019 from https://www.prnewswire.com/news-releases/data-from-phase-2-study-of-alder-biopharmaceuticals-anti-il-6-antibody-therapeutic-ald518-demonstrate-reversal-of-anemia-in-patients-with-advanced-non-small-cell-lung-cancer-111450629.html.
Ataie-Kachoie, Parvin et al., "Inhibition of the IL-6 signaling pathway: A strategy to combat chronic inflammatory diseases and cancer" Cytokine & Growth Factor Reviews 24 (2013) 163-173.
Coward, Jermaine et al., "Interleukin-6 as a therapeutic target in human ovarian cancer", Clin Cancer Res. Sep. 15, 2011; 17(18): 6083-6096.
Danese, Silvio, et al, "Randomised trial and open-label extension study of an anti-interleukin-6 antibody in Crohn's disease (ANDANTE I and II)", Gut, 2019;68:40-48, first published as 10.1136/gutjnl-2017-314562 online Dec. 15, 2017.
Hagihara, K. et al., "IL-6 plays a critical role in the synergistic induction of human serum anmyloid A (SAA) gene when stimulated with proinflammatory cytokines as analyzed with an SAA iso form real-time quantitative RT-PCT assay system", BBRC, 314 (2004) 363-369.
Mease, Philip J., "The Efficacy and Safety of Clazakizumab, an Anti-Interleukin-6 Monoclonal Antibody, in a Phase IIb Study of Adults With Active Psoriatic Arthritis", Arthritis & Rheumatology, vol. 68, No. 9, Sep. 2016, pp. 2163-2173.
Takeuchi, Tsutomu et al., Efficacy and safety of olokizumab in Asian patients with moderate-to-sever rheumatoid arthritis, previously exposed to anti-TNF therapy: Results from a randomized phase II trial; Modern Rheumatology, 26:1, 15-23, DOI:10,3109/14397595,2015.1074648.
Tanaka et al., "IL-6 in Inflammation, Immunity, and Disease", Cold Spring Harb Perspect Biol 2014;6:a016295; 16 pages.
Weinblatt, Michael E., "The Efficacy and Safety of Subcutaneous Clazakizumab in Patients With Moderate-to-Sever Rheumatoid Arthritis and an Inadequate Response to Methotrexate", Arthritis & Rheumatology, vol. 67, No. 10, Oct. 2015; pp. 2591-2600.
Yao, Xin et al., "Targeting interleukin-6 in inflammatory autoimmune diseases and cancers", Pharmacology & Thereapeutics 141 (2014) 125-139.
Non Final Office Action for U.S. Appl. No. 15/317,633, filed Dec. 9, 2016; dated Apr. 4, 2019; 19 pages.
Gronwall Caroline, et al., "Selection and characterization of Affibody ligands binding to Alzheimer amyioid B peptides", Journal of Bioteohnology 128 (2007) pp. 162-183.

* cited by examiner

FIG. 1A

| Designation | Sequence | SEQ ID NO |
|---|---|---|
| Z14976 | VDAKYAKEERKAWYEIHLLPNLTVEQMAAFITKLFDDPSQSSELLSEAKKLNDSQAPK | 1 |
| Z15015 | VDAKYAKEERDAWWEIHALPNLTVEQMAAFITKLFDDPSQSSELLSEAKKLNDSQAPK | 2 |
| Z15122 | VDAKYAKEERHAWYEIHLLPNLTIDQMAAFISKLFDDPSQSSELLSEAKKLNDSQAPK | 3 |
| Z14861 | VDAKYAKEERKAWIEIHNLPNLTIDQMAAFITKLFDDPSQSSELLSEAKKLNDSQAPK | 4 |
| Z14984 | VDAKYAKEERKQAWREIHLLPNLTIDQMAAFITKLFDDPSQSSELLSEAKKLNDSQAPK | 5 |
| Z14630 | VDAKYAKEEKFAWWEIHKLPNLTVDQVAAFITKLFDDPSQSSELLSEAKKLNDSQAPK | 6 |
| Z11632 | VDAKYAKEEREAWFEIHTLPNLTVSQMAAFITKLFDDPSQSSELLSEAKKLNDSQAPK | 7 |
| Z14700 | VDAKYAKEERHAWFEIHKLPNLTVDQMAAFITKLFDDPSQSSELLSEAKKLNDSQAPK | 8 |
| Z14712 | VDAKYAKEEYLAWNEIHKLPNLTVDQMAAFITKLFDDPSQSSELLSEAKKLNDSQAPK | 9 |
| Z14862 | VDAKYAKEEAAAWREIHLLPNLTIDQMAAFITKLFDDPSQSSELLSEAKKLNDSQAPK | 10 |
| Z15036 | VDAKYAKEEYEAWFEIHALPNLTVEQMAAFITKLFDDPSQSSELLSEAKKLNDSQAPK | 11 |
| Z15110 | VDAKYAKEERRAWTEIHSLPNLTIDQMAAFISKLFDDPSQSSELLSEAKKLNDSQAPK | 12 |
| Z15126 | VDAKYAKEERNAWYEIHLLPNLTVEQMAAFITKLFDDPSQSSELLSEAKKLNDSQAPK | 13 |
| Z15142 | VDAKYAKEERMAWYEIHSLPNLTVDQMAAFISKLFDDPSQSSELLSEAKKLNDSQAPK | 14 |
| Z11213 | VDAKYAKEEREAWYEIHVLPNLTVSQIAAFISKLFDDPSQSSELLSEAKKLNDSQAPK | 15 |
| Z11214 | VDAKYAKEERTAWFEIHTLPNLTVEQMAAFISKLFDDPSQSSELLSEAKKLNDSQAPK | 16 |
| Z11215 | VDAKYAKEEAEAWWEIHLLPNLTVSQMAAFISKLFDDPSQSSELLSEAKKLNDSQAPK | 17 |
| Z11217 | VDAKYAKEEREAWYEIHLLPNLTVEQMAAFISKLFDDPSQSSELLSEAKKLNDSQAPK | 18 |
| Z11222 | VDAKYAKEERDAWYEIHLLPNLTIDQMAAFISKLFDDPSQSSELLSEAKKLNDSQAPK | 19 |
| Z11251 | VDAKYAKEERKAWFEIHALPNLTVDQMAAFISKLFDDPSQSSELLSEAKKLNDSQAPK | 20 |
| Z11277 | VDAKYAKEEAKAWFEIHALPNLTVEQMAAFISKLFDDPSQSSELLSEAKKLNDSQAPK | 21 |
| Z11278 | VDAKYAKEERTAWYEIHILPNLTVSQMAAFISKLFDDPSQSSELLSEAKKLNDSQAPK | 22 |
| Z11283 | VDAKYAKEEQQAWTEIHSLPNLTVDQMAAFISKLFDDPSQSSELLSEAKKLNDSQAPK | 23 |
| Z11300 | VDAKYAKEERDAWYEIHLLPNLTVEQIAAFISKLFDDPSQSSELLSEAKKLNDSQAPK | 24 |
| Z11321 | VDAKYAKEERVAWYEIHLLPNLTITQMAAFISKLFDDPSQSSELLSEAKKLNDSQAPK | 25 |
| Z11329 | VDAKYAKEERQAWYEIHLLPNLTVQQMAAFISKLFDDPSQSSELLSEAKKLNDSQAPK | 26 |
| Z11351 | VDAKYAKEEASAWFEIHTLPNLTVQQMAAFISKLFDDPSQSSELLSEAKKLNDSQAPK | 27 |
| Z11380 | VDAKYAKEEREAWYEIHVLPNLTVDQMAAFISKLFDDPSQSSELLSEAKKLNDSQAPK | 28 |
| Z11384 | VDAKYAKEERKAWYEIHLLPNLTVNQMAAFISKLFDDPSQSSELLSEAKKLNDSQAPK | 29 |
| Z11433 | VDAKYAKEERKAWYEIHLLPNLTVDQMAAFISKLFDDPSQSSELLSEAKKLNDSQAPK | 30 |
| Z11472 | VDAKYAKEEARAWHEIHILPNLTVSQIAAFISKLFDDPSQSSELLSEAKKLNDSQAPK | 31 |
| Z11552 | VDAKYAKEERAAWYEIHLLPNLTVDQMAAFISKLFDDPSQSSELLSEAKKLNDSQAPK | 32 |
| Z11642 | VDAKYAKEERQAWYEIHTLPNLTAEQMAAFISKLFDDPSQSSELLSEAKKLNDSQAPK | 33 |

FIG. 1B

| Designation | Sequence | SEQ ID NO |
|---|---|---|
| Z11644 | VDAKYAKEERQAWFEIHALPNLTVDQMAAFISKLFDDPSQSSELLSEAKKLNDSQAPK | 34 |
| Z11674 | VDAKYAKEEARAWREIHLLPNLTVQQMAAFISKLFDDPSQSSELLSEAKKLNDSQAPK | 35 |
| Z11698 | VDAKYAKEEAKAWREIHLLPNLTVTQMAAFISKLFDDPSQSSELLSEAKKLNDSQAPK | 36 |
| Z11711 | VDAKYAKEEAEAWREIHLLPNLTVNQMAAFISKLFDDPSQSSELLSEAKKLNDSQAPK | 37 |
| Z11723 | VDAKYAKEERDAWYEIHLLPNLTVQQMAAFISKLFDDPSQSSELLSEAKKLNDSQAPK | 38 |
| Z11781 | VDAKYAKEEREAWYEIHLLPNLTVRQMAAFISKLFDDPSQSSELLSEAKKLNDSQAPK | 39 |
| Z11784 | VDAKYAKEEREAWWEIHKLPNLTVNQMAAFISKLFDDPSQSSELLSEAKKLNDSQAPK | 40 |
| Z11788 | VDAKYAKEERRAWYEIHLLPNLTIQQMAAFISKLFDDPSQSSELLSEAKKLNDSQAPK | 41 |
| Z11789 | VDAKYAKEEAEAWREIHLLPNLTVHQMAAFISKLFDDPSQSSELLSEAKKLNDSQAPK | 42 |
| Z11791 | VDAKYAKEERDAWHEIHLLPNLTVSQMAAFISKLFDDPSQSSELLSEAKKLNDSQAPK | 43 |
| Z11794 | VDAKYAKEERRAWYEIHTLPNLTVEQMAAFISKLFDDPSQSSELLSEAKKLNDSQAPK | 44 |
| Z11802 | VDAKYAKEERKAWFEIHKLPNLTVTQMAAFISKLFDDPSQSSELLSEAKKLNDSQAPK | 45 |
| Z11803 | VDAKYAKEEHHAWFEIHLLPNLTVQQMAAFIQKLFDDPSQSSELLSEAKKLNDSQAPK | 46 |
| Z11805 | VDAKYAKEEARAWFEIHALPNLTVQQVAAFISKLFDDPSQSSELLSEAKKLNDSQAPK | 47 |
| Z11814 | VDAKYAKEEAKAWREIHILPNLTVQQMAAFISKLFDDPSQSSELLSEAKKLNDSQAPK | 48 |
| Z11815 | VDAKYAKEEATAWHEIHTLPNLTVHQMAAFISKLFDDPSQSSELLSEAKKLNDSQAPK | 49 |
| Z11817 | VDAKYAKEERSAWYEIHLLPNLTVTQMAAFISKLFDDPSQSSELLSEAKKLNDSQAPK | 50 |
| Z11818 | VDAKYAKEERAAWFEIHTLPNLTVQQMAAFISKLFDDPSQSSELLSEAKKLNDSQAPK | 51 |
| Z11819 | VDAKYAKEERTAWYEIHLLPNLTVQQMAAFIQKLFDDPSQSSELLSEAKKLNDSQAPK | 52 |
| Z11823 | VDAKYAKEERAAWFEIHLLPNLTVSQMAAFISKLFDDPSQSSELLSEAKKLNDSQAPK | 53 |
| Z11824 | VDAKYAKEEHRAWFEIHLLPNLTVEQMAAFISKLFDDPSQSSELLSEAKKLNDSQAPK | 54 |
| Z11833 | VDAKYAKEERAAWYEIHLLPNLTVQQMAAFIQKLFDDPSQSSELLSEAKKLNDSQAPK | 55 |
| Z11835 | VDAKYAKEERQAWYEIHLLPNLTVSQIAAFISKLFDDPSQSSELLSEAKKLNDSQAPK | 56 |
| Z11836 | VDAKYAKEEAAAWREIHLLPNLTISQIAAFISKLFDDPSQSSELLSEAKKLNDSQAPK | 57 |
| Z11860 | VDAKYAKEEREAWHEIHILPNLTIHQMAAFISKLFDDPSQSSELLSEAKKLNDSQAPK | 58 |
| Z11861 | VDAKYAKEEAQAWLEIHLLPNLTVDQIAAFISKLFDDPSQSSELLSEAKKLNDSQAPK | 59 |
| Z11862 | VDAKYAKEERKAWFEIHALPNLTVTQMAAFISKLFDDPSQSSELLSEAKKLNDSQAPK | 60 |
| Z11865 | VDAKYAKEERDAWYEIHLLPNLTVSQIAAFISKLFDDPSQSSELLSEAKKLNDSQAPK | 61 |
| Z11866 | VDAKYAKEEAAAWYEIHLLPNLTIISQIAAFISKLFDDPSQSSELLSEAKKLNDSQAPK | 62 |
| Z11871 | VDAKYAKEERVAWYEIHLLPNLTVRQMAAFIIKLFDDPSQSSELLSEAKKLNDSQAPK | 63 |
| Z11872 | VDAKYAKEEHHAWYEIHALPNLTVSQIAAFISKLFDDPSQSSELLSEAKKLNDSQAPK | 64 |
| Z11874 | VDAKYAKEERAAWFEIHALPNLTVEQVAAFISKLFDDPSQSSELLSEAKKLNDSQAPK | 65 |
| Z11875 | VDAKYAKEEQEAWYEIHVLPNLTVTQMAAFISKLFDDPSQSSELLSEAKKLNDSQAPK | 66 |

FIG. 1C

| Designation | Sequence | SEQ ID NO |
|---|---|---|
| Z11881 | VDAKYAKEEQQAWTEIHTLPNLTVDQMAAFISKLFDDPSQSSELLSEAKKLNDSQAPK | 67 |
| Z11882 | VDAKYAKEERDAWYEIHLLPNLTVTQMAAFISKLFDDPSQSSELLSEAKKLNDSQAPK | 68 |
| Z11883 | VDAKYAKEERDAWYEIHLLPNLTISQMAAFISKLFDDPSQSSELLSEAKKLNDSQAPK | 69 |
| Z11890 | VDAKYAKEEREAWHEIHILPNLTVEQIAAFISKLFDDPSQSSELLSEAKKLNDSQAPK | 70 |
| Z11892 | VDAKYAKEERDAWWEIHALPNLTVDQMAAFISKLFDDPSQSSELLSEAKKLNDSQAPK | 71 |
| Z11893 | VDAKYAKEEARAWHEIHVLPNLTVSQMAAFIQKLFDDPSQSSELLSEAKKLNDSQAPK | 72 |
| Z11895 | VDAKYAKEEAQAWYEIHTLPNLTVEQMAAFIAKLFDDPSQSSELLSEAKKLNDSQAPK | 73 |
| Z11896 | VDAKYAKEERSAWWEIHTLPNLTVTQMAAFISKLFDDPSQSSELLSEAKKLNDSQAPK | 74 |
| Z11897 | VDAKYAKEEADAWWEIHALPNLTIDQMAAFISKLFDDPSQSSELLSEAKKLNDSQAPK | 75 |
| Z11901 | VDAKYAKEEAEAWYEIHLLPNLTVDQMAAFITKLFDDPSQSSELLSEAKKLNDSQAPK | 76 |
| Z11903 | VDAKYAKEERAAWYEIHSLPNLTVDQMAAFISKLFDDPSQSSELLSEAKKLNDSQAPK | 77 |
| Z11904 | VDAKYAKEEQQAWLEIHLLPNLTIEQMAAFISKLFDDPSQSSELLSEAKKLNDSQAPK | 78 |
| Z11905 | VDAKYAKEERDAWYEIHLLPNLTVHQIAAFISKLFDDPSQSSELLSEAKKLNDSQAPK | 79 |
| Z11906 | VDAKYAKEERDAWYEIHTLPNLTVEQMAAFIWKLFDDPSQSSELLSEAKKLNDSQAPK | 80 |
| Z11907 | VDAKYAKEEQHAWLEIHKLPNLTVEQIAAFISKLFDDPSQSSELLSEAKKLNDSQAPK | 81 |
| Z11912 | VDAKYAKEEAAAWFEIHTLPNLTVDQMAAFISKLFDDPSQSSELLSEAKKLNDSQAPK | 82 |
| Z11918 | VDAKYAKEERDAWFEIHTLPNLTVTQMAAFIIKLFDDPSQSSELLSEAKKLNDSQAPK | 83 |
| Z11922 | VDAKYAKEERHAWHEIHILPNLTANQIAAFISKLFDDPSQSSELLSEAKKLNDSQAPK | 84 |
| Z11923 | VDAKYAKEEREAWFEIHLLPNLTISQMAAFISKLFDDPSQSSELLSEAKKLNDSQAPK | 85 |
| Z11929 | VDAKYAKEEAEAWWEIHLLPNLTVQQIAAFISKLFDDPSQSSELLSEAKKLNDSQAPK | 86 |
| Z11933 | VDAKYAKEEAHAWYEIHILPNLTVSQMAAFITKLFDDPSQSSELLSEAKKLNDSQAPK | 87 |
| Z11937 | VDAKYAKEERDAWYEIHLLPNLTIDQIAAFISKLFDDPSQSSELLSEAKKLNDSQAPK | 88 |
| Z11939 | VDAKYAKEEQRAWREIHLLPNLTIEQMSAFISKLFDDPSQSSELLSEAKKLNDSQAPK | 89 |
| Z14521 | VDAKYAKEEYDAWMEIHLLPNLTVDQMAAFITKLFDDPSQSSELLSEAKKLNDSQAPK | 90 |
| Z14524 | VDAKYAKEEKHAWREIHLLPNLTVEQMAAFITKLFDDPSQSSELLSEAKKLNDSQAPK | 91 |
| Z14525 | VDAKYAKEEKKAWTEIHLLPNLTIEQMAAFITKLFDDPSQSSELLSEAKKLNDSQAPK | 92 |
| Z14538 | VDAKYAKEERFAWTEIHLLPNLTVDQMAAFITKLFDDPSQSSELLSEAKKLNDSQAPK | 93 |
| Z14547 | VDAKYAKEERHAWTEIHLLPNLTVDQMAAFITKLFDDPSQSSELLSEAKKLNDSQAPK | 94 |
| Z14550 | VDAKYAKEERAAWFEIHALPNLTVEQVAAFITKLFDDPSQSSELLSEAKKLNDSQAPK | 95 |
| Z14551 | VDAKYAKEEKQAWYEIHNLPNLTVDQMAAFITKLFDDPSQSSELLSEAKKLNDSQAPK | 96 |
| Z14556 | VDAKYAKEEAQAWWEIHALPNLILPNLTVDQVAAFITKLFDDPSQSSELLSEAKKLNDSQAPK | 97 |
| Z14559 | VDAKYAKEEYEAWYEIHILPNLTVDQIAAFITKLFDDPSQSSELLSEAKKLNDSQAPK | 98 |
| Z14596 | VDAKYAKEEYEAWHEIHILPNLTVDQMAAFITKLFDDPSQSSELLSEAKKLNDSQAPK | 99 |

FIG. 1D

| Designation | Sequence | SEQ ID NO |
|---|---|---|
| Z14609 | VDAKYAKEERMAWMEIHLLPNLTVEQMAAFISKLFDDPSQSSELLSEAKKLNDSQAPK | 100 |
| Z14614 | VDAKYAKEEYDAWVEIHALPNLTVEQVAAFITKLFDDPSQSSELLSEAKKLNDSQAPK | 101 |
| Z14620 | VDAKYAKEEYEAWVEIHKLPNLTIDQMAAFITKLFDDPSQSSELLSEAKKLNDSQAPK | 102 |
| Z14634 | VDAKYAKEEYHAWYEIHLLPNLTIDQMAAFITKLFDDPSQSSELLSEAKKLNDSQAPK | 103 |
| Z14645 | VDAKYAKEEKDAWYEIHLLPNLTVEQIAAFITKLFDDPSQSSELLSEAKKLNDSQAPK | 104 |
| Z14651 | VDAKYAKEEKHAWHEIHLLPNLTVEQMAAFITKLFDDPSQSSELLSEAKKLNDSQAPK | 105 |
| Z14662 | VDAKYAKEEKAAWFEIHALPNLTVEQVAAFITKLFDDPSQSSELLSEAKKLNDSQAPK | 106 |
| Z14673 | VDAKYAKEEYHAWMEIHLLPNLTVSQMAAFITKLFDDPSQSSELLSEAKKLNDSQAPK | 107 |
| Z14706 | VDAKYAKEEAFAWKEIHLLPNLTIDQMAAFITKLFDDPSQSSELLSEAKKLNDSQAPK | 108 |
| Z14710 | VDAKYAKEEYEAWYEIHLLPNLTVSQIAAFITKLFDDPSQSSELLSEAKKLNDSQAPK | 109 |
| Z14720 | VDAKYAKEEYYAWWEIHKLPNLTVDQMAAFITKLFDDPSQSSELLSEAKKLNDSQAPK | 110 |
| Z14722 | VDAKYAKEEAVAWKEIHILPNLTVSQMAAFITKLFDDPSQSSELLSEAKKLNDSQAPK | 111 |
| Z14731 | VDAKYAKEEKAAWYEIHLLPNLTIEQMAAFISKLFDDPSQSSELLSEAKKLNDSQAPK | 112 |
| Z14746 | VDAKYAKEERAAWTEIHLLPNLTVEQMAAFITKLFDDPSQSSELLSEAKKLNDSQAPK | 113 |
| Z14765 | VDAKYAKEERMAWYEIHTLPNLTVDQMAAFITKLFDDPSQSSELLSEAKKLNDSQAPK | 114 |
| Z14767 | VDAKYAKEEHHAWREIHLLPNLTVDQMAAFITKLFDDPSQSSELLSEAKKLNDSQAPK | 115 |
| Z14782 | VDAKYAKEEAKAWMEIHLLPNLTIDQMAAFITKLFDDPSQSSELLSEAKKLNDSQAPK | 116 |
| Z14783 | VDAKYAKEEKAAWYEIHLLPNLTVDQIAAFITKLFDDPSQSSELLSEAKKLNDSQAPK | 117 |
| Z14784 | VDAKYAKEEKHAWMEIHKLPNLTVDQMAAFITKLFDDPSQSSELLSEAKKLNDSQAPK | 118 |
| Z14788 | VDAKYAKEEKAAWNEIHNLPNLTVDQMAAFITKLFDDPSQSSELLSEAKKLNDSQAPK | 119 |
| Z14829 | VDAKYAKEERKAWVEIHNLPNLTVDQIAAFITKLFDDPSQSSELLSEAKKLNDSQAPK | 120 |
| Z14867 | VDAKYAKEEATAWHEIHVLPNLTVDQIAAFITKLFDDPSQSSELLSEAKKLNDSQAPK | 121 |
| Z14868 | VDAKYAKEEYEAWYEIHLLPNLTIQQMAAFITKLFDDPSQSSELLSEAKKLNDSQAPK | 122 |
| Z14878 | VDAKYAKEEYHAWVEIHLLPNLTIDQMAAFITKLFDDPSQSSELLSEAKKLNDSQAPK | 123 |
| Z14888 | VDAKYAKEEAFAWREIHLLPNLTVEQIAAFITKLFDDPSQSSELLSEAKKLNDSQAPK | 124 |
| Z14929 | VDAKYAKEEKAAWYEIHLLPNLTVSQMAAFITKLFDDPSQSSELLSEAKKLNDSQAPK | 125 |
| Z14944 | VDAKYAKEEKAAWNEIHKLPNLTVDQMAAFITKLFDDPSQSSELLSEAKKLNDSQAPK | 126 |
| Z14990 | VDAKYAKEERKAWYEIHTLPNLTVEQIAAFITKLFDDPSQSSELLSEAKKLNDSQAPK | 127 |
| Z14992 | VDAKYAKEERNAWTEIHLLPNLTIEQMAAFITKLFDDPSQSSELLSEAKKLNDSQAPK | 128 |
| Z15003 | VDAKYAKEEYKAWLEIHNLPNLTVDQMAAFITKLFDDPSQSSELLSEAKKLNDSQAPK | 129 |
| Z15024 | VDAKYAKEEYEAWMEIHLLPNLTVEQIAAFITKLFDDPSQSSELLSEAKKLNDSQAPK | 130 |
| Z15025 | VDAKYAKEERDAWFEIHKLPNLTVDQMAAFITKLFDDPSQSSELLSEAKKLNDSQAPK | 131 |
| Z15031 | VDAKYAKEEAYAWKEIHLLPNLTVDQMAAFITKLFDDPSQSSELLSEAKKLNDSQAPK | 132 |

FIG. 1E

| Designation | Sequence | SEQ ID NO |
|---|---|---|
| Z15042 | VDAKYAKEEYFAWWEIHKLPNLTVNQMAAFITKLFDDPSQSSELLSEAKKLNDSQAPK | 133 |
| Z15053 | VDAKYAKEEKQAWVEIHNLPNLTITQMAAFITKLFDDPSQSSELLSEAKKLNDSQAPK | 134 |
| Z15057 | VDAKYAKEEQRAWYEIHILPNLTIDQMAAFITKLFDDPSQSSELLSEAKKLNDSQAPK | 135 |
| Z15067 | VDAKYAKEEARAWREIHALPNLTIDQMAAFITKLFDDPSQSSELLSEAKKLNDSQAPK | 136 |
| Z15079 | VDAKYAKEERYAWNEIHKLPNLTVDQMAAFITKLFDDPSQSSELLSEAKKLNDSQAPK | 137 |
| Z15082 | VDAKYAKEEAKAWYEIHILPNLTVDQIAAFITKLFDDPSQSSELLSEAKKLNDSQAPK | 138 |
| Z15097 | VDAKYAKEEARAWHEIHILPNLTIDQMAAFITKLFDDPSQSSELLSEAKKLNDSQAPK | 139 |
| Z15102 | VDAKYAKEEKKAWYEIHLLPNLTIEQMAAFITKLFDDPSQSSELLSEAKKLNDSQAPK | 140 |
| Z15111 | VDAKYAKEEARAWTEIHLLPNLTVDQMAAFITKLFDDPSQSSELLSEAKKLNDSQAPK | 141 |
| Z15117 | VDAKYAKEERSAWMEIHLLPNLTVDQMAAFITKLFDDPSQSSELLSEAKKLNDSQAPK | 142 |
| Z15129 | VDAKYAKEEREAWFEIHILPNLTIDQMAAFITKLFDDPSQSSELLSEAKKLNDSQAPK | 143 |
| Z15140 | VDAKYAKEEYEAWTEIHLLPNLTVDQIAAFITKLFDDPSQSSELLSEAKKLNDSQAPK | 144 |
| Z15141 | VDAKYAKEEYEAWNEIHNLPNLTITQMAAFITKLFDDPSQSSELLSEAKKLNDSQAPK | 145 |
| Z15145 | VDAKYAKEEYKAWHEIHILPNLTIDQMAAFITKLFDDPSQSSELLSEAKKLNDSQAPK | 146 |
| Z15151 | VDAKYAKEEREAWMEIHLLPNLTIEQMAAFITKLFDDPSQSSELLSEAKKLNDSQAPK | 147 |
| Z15159 | VDAKYAKEEYKAWVEIHLLPNLTVDQIAAFITKLFDDPSQSSELLSEAKKLNDSQAPK | 148 |
| Z15162 | VDAKYAKEEKIAWYEIHLLPNLTVNQIAAFITKLFDDPSQSSELLSEAKKLNDSQAPK | 149 |
| Z15164 | VDAKYAKEEAYAWKEIHLLPNLTIEQMAAFISKLFDDPSQSSELLSEAKKLNDSQAPK | 150 |
| Z11612 | VDAKYAKEEQVAWWEISHLPNLTITQVVAFIQKLFDDPSQSSELLSEAKKLNDSQAPK | 151 |
| Z11616 | VDAKYAKEEQVAWWEIHLLPNLTIEQVVAFIQKLFDDPSQSSELLSEAKKLNDSQAPK | 152 |
| Z11133 | VDAKYAKEEREAWYEIHTLPNLTAQQMAAFIVKLYDDPSQSSELLSEAKKLNDSQAPK | 153 |
| Z11134 | VDAKYAKEEAQAWLEIHLLPNLTVDQMAAFISKLFDDPSQSSELLSEAKKLNDSQAPK | 154 |
| Z11135 | VDAKYAKEERHAWFEIHSLPNLTVNQMSAFISKLFDDPSQSSELLSEAKKLNDSQAPK | 155 |
| Z11136 | VDAKYAKEEADAWWEIHALPNLTVDQMAAFISKLFDDPSQSSELLSEAKKLNDSQAPK | 156 |
| Z11137 | VDAKYAKEEARAWLEIHALPNLTVTQMAAFITKLFDDPSQSSELLSEAKKLNDSQAPK | 157 |
| Z11138 | VDAKYAKEERRAWNEIHLLPNLTIKLYDDPSQSSELLSEAKKLNDSQAPK | 158 |
| Z11139 | VDAKYAKEERHAWYEIHTLPNLTVTQMSAFIQKLFDDPSQSSELLSEAKKLNDSQAPK | 159 |
| Z11140 | VDAKYAKEEAQAWFEIHLLPNLTIDQMAAFISKLFDDPSQSSELLSEAKKLNDSQAPK | 160 |
| Z11141 | VDAKYAKEERAAWHEIHVLPNLTIVSQMAAFIIKLFDDPSQSSELLSEAKKLNDSQAPK | 161 |
| Z11142 | VDAKYAKEEREAWYEIHTLPNLTINQRTAFIQKLFDDPSQSSELLSEAKKLNDSQAPK | 162 |
| Z11143 | VDAKYAKEEAWYEIHVLPNLTVHQRAAFISKLFDDPSQSSELLSEAKKLNDSQAPK | 163 |
| Z11144 | VDAKYAKEERHAWFEIHTLPNLTVHVIAAFISKLFDDPSQSSELLSEAKKLNDSQAPK | 164 |
| Z11145 | VDAKYAKEERHAWYEIHVLPNLTVSQMAAFIMKLFDDPSQSSELLSEAKKLNDSQAPK | 165 |

FIG. 1F

| Designation | Sequence | SEQ ID NO |
|---|---|---|
| Z11146 | VDAKYAKEERDAWLEIHMLPNLTITQVAAFISKLFDDPSQSSELLSEAKKLNDSQAPK | 166 |
| Z11147 | VDAKYAKEEARAWHEIHVLPNLTAEQMAAFISKLFDDPSQSSELLSEAKKLNDSQAPK | 167 |
| Z11148 | VDAKYAKEEAEAWLEIHLLPNLTVEQITAFISKLFDDPSQSSELLSEAKKLNDSQAPK | 168 |
| Z11149 | VDAKYAKEERDAWHEIHLLPNLTVEQRAAFISKLFDDPSQSSELLSEAKKLNDSQAPK | 169 |
| Z11150 | VDAKYAKEERKAWTEIHSLPNLTVTQMAAFISKLFDDPSQSSELLSEAKKLNDSQAPK | 170 |
| Z11151 | VDAKYAKEERDAWHEIHILPNLTVEQMSAFISKLFDDPSQSSELLSEAKKLNDSQAPK | 171 |
| Z11152 | VDAKYAKEEAEAWFEIHALPNLTAEQMAAFISKLFDDPSQSSELLSEAKKLNDSQAPK | 172 |
| Z11153 | VDAKYAKEEHQAWWEIHLLPNLTVDQMSAFISKLFDDPSQSSELLSEAKKLNDSQAPK | 173 |
| Z11154 | VDAKYAKEERDAWHEIHKLPNLTVNQVAAFISKLFDDPSQSSELLSEAKKLNDSQAPK | 174 |
| Z11155 | VDAKYAKEEADAWFEIHLLPNLTVDQIAAFIQKLFDDPSQSSELLSEAKKLNDSQAPK | 175 |
| Z11156 | VDAKYAKEERAAWYEIHVLPNLTVEQMAAFIQKLFDDPSQSSELLSEAKKLNDSQAPK | 176 |
| Z11157 | VDAKYAKEEIHRAWHEIHLLPNLTVNQIAAFISKLFDDPSQSSELLSEAKKLNDSQAPK | 177 |
| Z11158 | VDAKYAKEEAVAWHEIHMLPNLTVEQMAAFISKLFDDPSQSSELLSEAKKLNDSQAPK | 178 |
| Z11159 | VDAKYAKEEREAWWEIHALPNLTVSQMAAFISKLFDDPSQSSELLSEAKKLNDSQAPK | 179 |
| Z11160 | VDAKYAKEERKAWFEIHSLPNLTVDQMSAFISKLFDDPSQSSELLSEAKKLNDSQAPK | 180 |
| Z11161 | VDAKYAKEEQRAWWEIHTLPNLTTDQMAAFISKLFDDPSQSSELLSEAKKLNDSQAPK | 181 |
| Z11162 | VDAKYAKEERQAWFEIHALPNLTVDQAAAFIIKLYDDPSQSSELLSEAKKLNDSQAPK | 182 |
| Z11163 | VDAKYAKEEARAWTEIHALPNLTVDWMAAFISKLFDDPSQSSELLSEAKKLNDSQAPK | 183 |
| Z11164 | VDAKYAKEERRAWHEIHMLPNLTVTQMSAFISKLFDDPSQSSELLSEAKKLNDSQAPK | 184 |
| Z11165 | VDAKYAKEEAKAWLEIHLLPNLTVNQMAAFISKLFDDPSQSSELLSEAKKLNDSQAPK | 185 |
| Z11166 | VDAKYAKEEREAWHEIHLLPNLTIISQIAAFISKLFDDPSQSSELLSEAKKLNDSQAPK | 186 |
| Z11167 | VDAKYAKEEQHAWYEIHLLPNLTVTQMAAFISKLFDDPSQSSELLSEAKKLNDSQAPK | 187 |
| Z11168 | VDAKYAKEEHKAWFEIHLLPNLTISQMAAFISKLFDDPSQSSELLSEAKKLNDSQAPK | 188 |
| Z11169 | VDAKYAKEERRAWYEIHLLPNLTVTQMTAFISKLFDDPSQSSELLSEAKKLNDSQAPK | 189 |
| Z11170 | VDAKYAKEERHAWTEIHILPNLTVRQMAAFISKLFDDPSQSSELLSEAKKLNDSQAPK | 190 |
| Z11171 | VDAKYAKEERHAWHEIHLLPNLTIQQMAAFISKLFDDPSQSSELLSEAKKLNDSQAPK | 191 |
| Z11172 | VDAKYAKEEQHAWTEIHKLPNLTIQQMAAFIQKLFDDPSQSSELLSEAKKLNDSQAPK | 192 |
| Z11173 | VDAKYAKEEHRAWTEIHLLPNLTVSQMVAFISKLFDDPSQSSELLSEAKKLNDSQAPK | 193 |
| Z11174 | VDAKYAKEEQDAWYEIHVLPNLTVEQLVAFISKLFDDPSQSSELLSEAKKLNDSQAPK | 194 |
| Z11175 | VDAKYAKEEREAWHEIHSLPNLTVDQMTAFIKLMDDPSQSSELLSEAKKLNDSQAPK | 195 |
| Z11176 | VDAKYAKEEAAAWFEIHLLPNLTTEQMAAFIMKLFDDPSQSSELLSEAKKLNDSQAPK | 196 |
| Z11177 | VDAKYAKEEARAWYEIHILPNLTVRQMAAFISKLFDDPSQSSELLSEAKKLNDSQAPK | 197 |
| Z11178 | VDAKYAKEEARAWTEIHALPNLTVDQVTAFIIKLYDDPSQSSELLSEAKKLNDSQAPK | 198 |

FIG. 1G

| Designation | Sequence | SEQ ID NO |
|---|---|---|
| Z11179 | VDAKYAKEEQRAWFEIHTLPNLTVDQIEAFISKLFDDPSQSSELLSEAKKLNDSQAPK | 199 |
| Z11180 | VDAKYAKEEAAAWHEIHILPNLTVSQMAAFISKLFDDPSQSSELLSEAKKLNDSQAPK | 200 |
| Z11181 | VDAKYAKEEAQAWWEIHSLPNLTVEQTSAFIQKLFDDPSQSSELLSEAKKLNDSQAPK | 201 |
| Z11182 | VDAKYAKEEREAWHEIHALPNLTIDQRVAFISKLFDDPSQSSELLSEAKKLNDSQAPK | 202 |
| Z11183 | VDAKYAKEEREAWYEIHLLPNLTINQMAAFISKLFDDPSQSSELLSEAKKLNDSQAPK | 203 |
| Z11184 | VDAKYAKEERDAWYEIHLLPNLTIRQMAAFISKLFDDPSQSSELLSEAKKLNDSQAPK | 204 |
| Z11185 | VDAKYAKEEQKAWTEIHLLPNLTVHQIAAFISKLFDDPSQSSELLSEAKKLNDSQAPK | 205 |
| Z11186 | VDAKYAKEERAAWREIHLLPNLTTEQRTAFISKLFDDPSQSSELLSEAKKLNDSQAPK | 206 |
| Z11187 | VDAKYAKEEQDAWREIHLLPNLTINQIVAFIQKLFDDPSQSSELLSEAKKLNDSQAPK | 207 |
| Z11188 | VDAKYAKEEREAWYEIHSLPNLTVTQIAAFISKLFDDPSQSSELLSEAKKLNDSQAPK | 208 |
| Z11189 | VDAKYAKEEATAWYEIHILPNLTVDQMAAFISKLFDDPSQSSELLSEAKKLNDSQAPK | 209 |
| Z11190 | VDAKYAKEERDAWYEIHKLPNLTANQMAAFISKLFDDPSQSSELLSEAKKLNDSQAPK | 210 |
| Z11191 | VDAKYAKEERDAWFEIHALPNLTVHQMTAFIIKLFDDPSQSSELLSEAKKLNDSQAPK | 211 |
| Z11192 | VDAKYAKEEREAWSEIHKLPNLTVDQMAAFISKLFDDPSQSSELLSEAKKLNDSQAPK | 212 |
| Z11193 | VDAKYAKEEREAWFEIHLLPNLTVDQMAAFISKLFDDPSQSSELLSEAKKLNDSQAPK | 213 |
| Z11194 | VDAKYAKEERKAWYEIHLLPNLTVQQMAAFISKLFDDPSQSSELLSEAKKLNDSQAPK | 214 |
| Z11195 | VDAKYAKEEREAWYEIHSLPNLTVNQVAAFISKLFDDPSQSSELLSEAKKLNDSQAPK | 215 |
| Z11196 | VDAKYAKEERHAWREIHLLPNLTTEQRVAFIQKLFDDPSQSSELLSEAKKLNDSQAPK | 216 |
| Z11197 | VDAKYAKEEREAWTEIHSLPNLTVDQVTAFISKLFDDPSQSSELLSEAKKLNDSQAPK | 217 |
| Z11198 | VDAKYAKEERDAWWEIHLLPNLTVNQISAFISKLFDDPSQSSELLSEAKKLNDSQAPK | 218 |
| Z11199 | VDAKYAKEEHHAWREIHLLPNLTVEQMAAFISKLFDDPSQSSELLSEAKKLNDSQAPK | 219 |
| Z11200 | VDAKYAKEEQQAWHEIHLLPNLTVDQMAAFISKLFDDPSQSSELLSEAKKLNDSQAPK | 220 |
| Z11201 | VDAKYAKEEAQAWHEIHTLPNLTIHQMSAFISKLFDDPSQSSELLSEAKKLNDSQAPK | 221 |
| Z11202 | VDAKYAKEEAKAWWEIHVLPNLTIDQIAAFISKLFDDPSQSSELLSEAKKLNDSQAPK | 222 |
| Z11203 | VDAKYAKEEAQAWHEIHTLPNLTTEQMAAFISKLFDDPSQSSELLSEAKKLNDSQAPK | 223 |
| Z11204 | VDAKYAKEERDAWSEIHSLPNLTISQMAAFISKLFDDPSQSSELLSEAKKLNDSQAPK | 224 |
| Z11205 | VDAKYAKEERKAWHEIHILPNLTAEQLAAFISKLFDDPSQSSELLSEAKKLNDSQAPK | 225 |
| Z11206 | VDAKYAKEEADAWREIHVLPNLTTQQITAFIQKLFDDPSQSSELLSEAKKLNDSQAPK | 226 |
| Z11207 | VDAKYAKEERSAWTEIHMLPNLTVQQRAAFISKLFDDPSQSSELLSEAKKLNDSQAPK | 227 |
| Z11208 | VDAKYAKEEREAWYEIHLLPNLTIDQMSAFISKLFDDPSQSSELLSEAKKLNDSQAPK | 228 |
| Z11209 | VDAKYAKEERKAWFEIHLLPNLTVEQIVAFIQKLFDDPSQSSELLSEAKKLNDSQAPK | 229 |
| Z11210 | VDAKYAKEEREAWYEIHLLPNLTVNQMAAFISKLFDDPSQSSELLSEAKKLNDSQAPK | 230 |
| Z11211 | VDAKYAKEEADAWFEIHLLPNLTIDQVSAFISKLFDDPSQSSELLSEAKKLNDSQAPK | 231 |

FIG. 1H

| Designation | Sequence | SEQ ID NO |
|---|---|---|
| Z11212 | VDAKYAKEERDAWFEIHLLPNLTIEQMAAFISKLFDDPSQSSELLSEAKKLNDSQAPK | 232 |
| Z11216 | VDAKYAKEEADAWREIHTLPNLTVDQMSAFISKLFDDPSQSSELLSEAKKLNDSQAPK | 233 |
| Z11219 | VDAKYAKEERVAWYEIHMLPNLTINQMAAFISKLFDDPSQSSELLSEAKKLNDSQAPK | 234 |
| Z11220 | VDAKYAKEERDAWYEIHLLPNLTVNQMAAFISKLFDDPSQSSELLSEAKKLNDSQAPK | 235 |
| Z11221 | VDAKYAKEERDAWWEIHSLPNLTTQQMAAFIIKLYDDPSQSSELLSEAKKLNDSQAPK | 236 |
| Z11223 | VDAKYAKEERARWHEIHTLPNLTIEQMAAFISKLFDDPSQSSELLSEAKKLNDSQAPK | 237 |
| Z11225 | VDAKYAKEERAAWYEIHLLPNLTVEQTAAFISKLFDDPSQSSELLSEAKKLNDSQAPK | 238 |
| Z11226 | VDAKYAKEEREAWYEIHLLPNLTVEQIAAFISKLFDDPSQSSELLSEAKKLNDSQAPK | 239 |
| Z11227 | VDAKYAKEEQHAWREIHLLPNLTTDQMAAFIQKLFDDPSQSSELLSEAKKLNDSQAPK | 240 |
| Z11228 | VDAKYAKEEASAWWEIHLLPNLTTTQRAAFISKLFDDPSQSSELLSEAKKLNDSQAPK | 241 |
| Z11230 | VDAKYAKEEATAWYEIHALPNLTVDQMVAFISKLFDDPSQSSELLSEAKKLNDSQAPK | 242 |
| Z11231 | VDAKYAKEEHKAWTEIHLLPNLTVSQISAFISKLFDDPSQSSELLSEAKKLNDSQAPK | 243 |
| Z11232 | VDAKYAKEEQAAWREIHTLPNLTIEQIAAFISKLFDDPSQSSELLSEAKKLNDSQAPK | 244 |
| Z11233 | VDAKYAKEERAAWFEIHTLPNLTVNQMAAFISKLFDDPSQSSELLSEAKKLNDSQAPK | 245 |
| Z11234 | VDAKYAKEEAAAWFEIHALPNLTVNQMAAFISKLFDDPSQSSELLSEAKKLNDSQAPK | 246 |
| Z11236 | VDAKYAKEEAKAWFEIHKLPNLTAEQISAFIIKLFDDPSQSSELLSEAKKLNDSQAPK | 247 |
| Z11238 | VDAKYAKEEREAWYEIHLLPNLTVQQIVAFIIKLFDDPSQSSELLSEAKKLNDSQAPK | 248 |
| Z11239 | VDAKYAKEEQQAWYEIHLLPNLTIEQMAAFISKLFDDPSQSSELLSEAKKLNDSQAPK | 249 |
| Z11240 | VDAKYAKEERDAWFEIHALPNLTVDQMVAFISKLFDDPSQSSELLSEAKKLNDSQAPK | 250 |
| Z11241 | VDAKYAKEERAAWFEIHTLPNLTVQQMAAFISKLFDDPSQSSELLSEAKKLNDSQAPK | 251 |
| Z11242 | VDAKYAKEEQKAWHEIHKLPNLTVDQTTAFISKLFDDPSQSSELLSEAKKLNDSQAPK | 252 |
| Z11243 | VDAKYAKEEREAWYEIHLLPNLTIEQMVAFISKLFDDPSQSSELLSEAKKLNDSQAPK | 253 |
| Z11244 | VDAKYAKEEAEAWFEIHTLPNLTVDQMAAFIVKLYDDPSQSSELLSEAKKLNDSQAPK | 254 |
| Z11245 | VDAKYAKEEAEAWFEIHLLPNLTVTQIAAFISKLFDDPSQSSELLSEAKKLNDSQAPK | 255 |
| Z11246 | VDAKYAKEERQAWYEIHALPNLTADQMAAFIQKLFDDPSQSSELLSEAKKLNDSQAPK | 256 |
| Z11247 | VDAKYAKEEQSAWYEIHALPNLTVQQMEAFISKLFDDPSQSSELLSEAKKLNDSQAPK | 257 |
| Z11248 | VDAKYAKEEADAWLEIHLLPNLTVEQMAAFISKLFDDPSQSSELLSEAKKLNDSQAPK | 258 |
| Z11249 | VDAKYAKEEQQAWWEIHTLPNLTVDQRSAFIVKLYDDPSQSSELLSEAKKLNDSQAPK | 259 |
| Z11250 | VDAKYAKEERKAWHEIHILPNLTVNQISAFIQKLFDDPSQSSELLSEAKKLNDSQAPK | 260 |
| Z11252 | VDAKYAKEEAHAWWEIHKLPNLTTDQTAAFISKLFDDPSQSSELLSEAKKLNDSQAPK | 261 |
| Z11253 | VDAKYAKEERDAWYEIHILPNLTVTQMAAFISKLFDDPSQSSELLSEAKKLNDSQAPK | 262 |
| Z11254 | VDAKYAKEEAQAWREIHTLPNLTAQQMAAFISKLFDDPSQSSELLSEAKKLNDSQAPK | 263 |
| Z11255 | VDAKYAKEERRAWHEIHVLPNLTVEQMAAFISKLFDDPSQSSELLSEAKKLNDSQAPK | 264 |

FIG. 11

| Designation | Sequence | SEQ ID NO |
|---|---|---|
| Z11256 | VDAKYAKEEREAWSEIHLLPNLTVTQMAAFISKLFDDPSQSSELLSEAKKLNDSQAPK | 265 |
| Z11257 | VDAKYAKEERKAWYEIHLLPNLTVSQMAAFISKLFDDPSQSSELLSEAKKLNDSQAPK | 266 |
| Z11258 | VDAKYAKEEARAWYEIHLLPNLTVTQMAAFISKLFDDPSQSSELLSEAKKLNDSQAPK | 267 |
| Z11259 | VDAKYAKEEHEAWTEIHKLPNLTTEQMAAFISKLFDDPSQSSELLSEAKKLNDSQAPK | 268 |
| Z11260 | VDAKYAKEERDAWFEIHSLPNLTVQQMAAFISKLFDDPSQSSELLSEAKKLNDSQAPK | 269 |
| Z11261 | VDAKYAKEEQSAWHEIHLLPNLTVDQIAAFISKLFDDPSQSSELLSEAKKLNDSQAPK | 270 |
| Z11262 | VDAKYAKEEQAAWYEIHALPNLTVDQMTAFISKLFDDPSQSSELLSEAKKLNDSQAPK | 271 |
| Z11263 | VDAKYAKEEAAAWREIHLLPNLTTQQMAAFISKLFDDPSQSSELLSEAKKLNDSQAPK | 272 |
| Z11264 | VDAKYAKEEREAWYEIHILPNLTVEQMAAFISKLFDDPSQSSELLSEAKKLNDSQAPK | 273 |
| Z11265 | VDAKYAKEERKAWYEIHTLPNLTVDQMAAFISKLFDDPSQSSELLSEAKKLNDSQAPK | 274 |
| Z11266 | VDAKYAKEEAKAWREIHLLPNLTVEQMAAFISKLFDDPSQSSELLSEAKKLNDSQAPK | 275 |
| Z11267 | VDAKYAKEEAQAWSEIHMLPNLTVTQIAAFISKLFDDPSQSSELLSEAKKLNDSQAPK | 276 |
| Z11268 | VDAKYAKEEAHAWHEIHILPNLTVDQMSAFISKLFDDPSQSSELLSEAKKLNDSQAPK | 277 |
| Z11269 | VDAKYAKEEREAWFEIHLLPNLTVEQIAAFISKLFDDPSQSSELLSEAKKLNDSQAPK | 278 |
| Z11270 | VDAKYAKEERKAWWEIHLLPNLTIEQMAAFISKLFDDPSQSSELLSEAKKLNDSQAPK | 279 |
| Z11271 | VDAKYAKEERDAWYEIHTLPNLTVEQMVAFISKLFDDPSQSSELLSEAKKLNDSQAPK | 280 |
| Z11272 | VDAKYAKEERKAWYEIHALPNLTVSQMAAFIKLYDDPSQSSELLSEAKKLNDSQAPK | 281 |
| Z11273 | VDAKYAKEEHKAWWEIHALPNLTISQITAFISKLFDDPSQSSELLSEAKKLNDSQAPK | 282 |
| Z11274 | VDAKYAKEEAQAWYEIHLLPNLTIEQMAAFISKLFDDPSQSSELLSEAKKLNDSQAPK | 283 |
| Z11275 | VDAKYAKEEAQAWYEIHALPNLTIDQMAAFISKLFDDPSQSSELLSEAKKLNDSQAPK | 284 |
| Z11276 | VDAKYAKEEHDAWWEIHILPNLTVEQIAAFISKLFDDPSQSSELLSEAKKLNDSQAPK | 285 |
| Z11279 | VDAKYAKEEARAWLEIHTLPNLTITQRAAFISKLFDDPSQSSELLSEAKKLNDSQAPK | 286 |
| Z11281 | VDAKYAKEERKAWHEIHILPNLTINQRAAFISKLFDDPSQSSELLSEAKKLNDSQAPK | 287 |
| Z11282 | VDAKYAKEEREAWYEIHMLPNLTVTQMAAFISKLFDDPSQSSELLSEAKKLNDSQAPK | 288 |
| Z11284 | VDAKYAKEERDAWFEIHILPNLTIHQMAAFISKLFDDPSQSSELLSEAKKLNDSQAPK | 289 |
| Z11285 | VDAKYAKEERDAWYEIHTLPNLTVDQMVAFISKLFDDPSQSSELLSEAKKLNDSQAPK | 290 |
| Z11286 | VDAKYAKEEAQAWYEIHTLPNLTVDQIAAFISKLFDDPSQSSELLSEAKKLNDSQAPK | 291 |
| Z11287 | VDAKYAKEERVAWWEIHSLPNLTIDQRSAFISKLFDDPSQSSELLSEAKKLNDSQAPK | 292 |
| Z11288 | VDAKYAKEEHEAWTEIHLLPNLTVSQIAAFISKLFDDPSQSSELLSEAKKLNDSQAPK | 293 |
| Z11289 | VDAKYAKEEAQAWREIHLLPNLTVDQIAAFISKLFDDPSQSSELLSEAKKLNDSQAPK | 294 |
| Z11290 | VDAKYAKEERDAWHEIHVLPNLTAEQMSAFISKLFDDPSQSSELLSEAKKLNDSQAPK | 295 |
| Z11291 | VDAKYAKEEATAWFEIHTLPNLTVDQMAAFISKLFDDPSQSSELLSEAKKLNDSQAPK | 296 |
| Z11293 | VDAKYAKEERHAWFEIHTLPNLTVTQMAAFISKLFDDPSQSSELLSEAKKLNDSQAPK | 297 |

FIG. 1J

| Designation | Sequence | SEQ ID NO |
|---|---|---|
| Z11294 | VDAKYAKEEREAWWEIHALPNLTTNQVAAFISKLFDDPSQSSELLSEAKKLNDSQAPK | 298 |
| Z11295 | VDAKYAKEERRAWWEIHLLPNLTIQQIAAFISKLFDDPSQSSELLSEAKKLNDSQAPK | 299 |
| Z11296 | VDAKYAKEEAHAWFEIHILPNLTIDQMAAFISKLFDDPSQSSELLSEAKKLNDSQAPK | 300 |
| Z11297 | VDAKYAKEEARAWREIHLLPNLTVEQMAAFISKLFDDPSQSSELLSEAKKLNDSQAPK | 301 |
| Z11298 | VDAKYAKEERRAWYEIHTLPNLTVEQLSAFISKLFDDPSQSSELLSEAKKLNDSQAPK | 302 |
| Z11299 | VDAKYAKEEAHAWHEIHVLPNLTVEQIAAFISKLFDDPSQSSELLSEAKKLNDSQAPK | 303 |
| Z11301 | VDAKYAKEEREAWFEIHTLPNLTVEQMAAFISKLFDDPSQSSELLSEAKKLNDSQAPK | 304 |
| Z11302 | VDAKYAKEERDAWWEIHSLPNLTIDQMAAFISKLFDDPSQSSELLSEAKKLNDSQAPK | 305 |
| Z11303 | VDAKYAKEEARAWHEIHILPNLTIQQITAFIQKLFDDPSQSSELLSEAKKLNDSQAPK | 306 |
| Z11304 | VDAKYAKEEQKAWHEIHLLPNLTINQIVAFISKLFDDPSQSSELLSEAKKLNDSQAPK | 307 |
| Z11305 | VDAKYAKEEREAWYEIHILPNLTVEQMAAFIVKLFDDPSQSSELLSEAKKLNDSQAPK | 308 |
| Z11306 | VDAKYAKEERVAWYEIHALPNLTVTQMAAFISKLFDDPSQSSELLSEAKKLNDSQAPK | 309 |
| Z11307 | VDAKYAKEERVAWLEIHALPNLTVDQMVAFIIKLFDDPSQSSELLSEAKKLNDSQAPK | 310 |
| Z11308 | VDAKYAKEERDAWFEIHMLPNLTVNQMAAFIKLFDDPSQSSELLSEAKKLNDSQAPK | 311 |
| Z11309 | VDAKYAKEEAVAWFEIHTLPNLTVEQMAAFIVKLFDDPSQSSELLSEAKKLNDSQAPK | 312 |
| Z11310 | VDAKYAKEEQDAWSEIHLLPNLTVNQMAAFISKLFDDPSQSSELLSEAKKLNDSQAPK | 313 |
| Z11311 | VDAKYAKEERDAWWEIHALPNLTVDQMVAFISKLFDDPSQSSELLSEAKKLNDSQAPK | 314 |
| Z11312 | VDAKYAKEEAHAWHEIHVLPNLTVHQVAAFISKLFDDPSQSSELLSEAKKLNDSQAPK | 315 |
| Z11313 | VDAKYAKEEREAWYEIHLLPNLTVDQITAFISKLFDDPSQSSELLSEAKKLNDSQAPK | 316 |
| Z11314 | VDAKYAKEEQEAWYEIHTLPNLTISQMAAFISKLFDDPSQSSELLSEAKKLNDSQAPK | 317 |
| Z11315 | VDAKYAKEERDAWYEIHTLPNLTVEQMAAFISKLFDDPSQSSELLSEAKKLNDSQAPK | 318 |
| Z11316 | VDAKYAKEERQAWTEIHLLPNLTVDQIAAFISKLFDDPSQSSELLSEAKKLNDSQAPK | 319 |
| Z11317 | VDAKYAKEERDAWLEIHLLPNLTVEQMAAFISKLFDDPSQSSELLSEAKKLNDSQAPK | 320 |
| Z11318 | VDAKYAKEEQRAWTEIHTLPNLTVDQMAAFISKLFDDPSQSSELLSEAKKLNDSQAPK | 321 |
| Z11319 | VDAKYAKEERKAWWEIHLLPNLTVDQITAFISKLFDDPSQSSELLSEAKKLNDSQAPK | 322 |
| Z11320 | VDAKYAKEEARAWHEIHILPNLTVDQIAAFISKLFDDPSQSSELLSEAKKLNDSQAPK | 323 |
| Z11322 | VDAKYAKEEREAWHEIHILPNLTVTQMAAFISKLFDDPSQSSELLSEAKKLNDSQAPK | 324 |
| Z11323 | VDAKYAKEEQDAWWEIHKLPNLTTHQVAAFISKLFDDPSQSSELLSEAKKLNDSQAPK | 325 |
| Z11324 | VDAKYAKEERRAWFEIHALPNLTTEQMAAFIWKLFDDPSQSSELLSEAKKLNDSQAPK | 326 |
| Z11325 | VDAKYAKEEAAAWFEIHTLPNLTIEQMSAFISKLFDDPSQSSELLSEAKKLNDSQAPK | 327 |
| Z11326 | VDAKYAKEEREAWFEIHLLPNLTIEQMVAFISKLFDDPSQSSELLSEAKKLNDSQAPK | 328 |
| Z11327 | VDAKYAKEERKAWYEIHTLPNLTVNQMAAFISKLFDDPSQSSELLSEAKKLNDSQAPK | 329 |
| Z11328 | VDAKYAKEERQAWLEIHLLPNLTIEQMAAFISKLFDDPSQSSELLSEAKKLNDSQAPK | 330 |

FIG. 1K

| Designation | Sequence | SEQ ID NO |
|---|---|---|
| Z11330 | VDAKYAKEEHHAWLEIHTLPNLTVDQMAAFISKLFDDPSQSSELLSEAKKLNDSQAPK | 331 |
| Z11331 | VDAKYAKEEQQAWWEIHKLPNLTVEQMTAFIIKLYDDPSQSSELLSEAKKLNDSQAPK | 332 |
| Z11332 | VDAKYAKEERKAWFEIHALPNLTVTQVAAFISKLFDDPSQSSELLSEAKKLNDSQAPK | 333 |
| Z11333 | VDAKYAKEEHRAWTEIHKLPNLTTQQMAAFISKLFDDPSQSSELLSEAKKLNDSQAPK | 334 |
| Z11334 | VDAKYAKEEAQAWHEIHILPNLTVDQMAAFISKLFDDPSQSSELLSEAKKLNDSQAPK | 335 |
| Z11335 | VDAKYAKEEQKAWFEIHLLPNLTVEQIAAFIQKLFDDPSQSSELLSEAKKLNDSQAPK | 336 |
| Z11336 | VDAKYAKEERHAWYEIHLLPNLTVRQMAAFISKLFDDPSQSSELLSEAKKLNDSQAPK | 337 |
| Z11337 | VDAKYAKEERDAWYEIHLLPNLTVNQIAAFISKLFDDPSQSSELLSEAKKLNDSQAPK | 338 |
| Z11338 | VDAKYAKEEAHAWWEIHALPNLTVDQMAAFISKLFDDPSQSSELLSEAKKLNDSQAPK | 339 |
| Z11339 | VDAKYAKEEADAWFEIHVLPNLTIQQIAAFISKLFDDPSQSSELLSEAKKLNDSQAPK | 340 |
| Z11340 | VDAKYAKEERRAWFEIHILPNLTVNQMAAFISKLFDDPSQSSELLSEAKKLNDSQAPK | 341 |
| Z11341 | VDAKYAKEERKAWYEIHVLPNLTVRQMAAFIQKLFDDPSQSSELLSEAKKLNDSQAPK | 342 |
| Z11342 | VDAKYAKEERHAWHEIHILPNLTVDQISAFISKLFDDPSQSSELLSEAKKLNDSQAPK | 343 |
| Z11343 | VDAKYAKEERKAWLEIHLLPNLTVEQMAAFISKLFDDPSQSSELLSEAKKLNDSQAPK | 344 |
| Z11344 | VDAKYAKEEREAWWEIHKLPNLTVTQMAAFISKLFDDPSQSSELLSEAKKLNDSQAPK | 345 |
| Z11345 | VDAKYAKEERHAWYEIHTLPNLTVNQMAAFISKLFDDPSQSSELLSEAKKLNDSQAPK | 346 |
| Z11346 | VDAKYAKEERHAWYEIHVLPNLTVQQMAAFIQKLFDDPSQSSELLSEAKKLNDSQAPK | 347 |
| Z11347 | VDAKYAKEERHAWWEIHALPNLTVEQIAAFIQKLFDDPSQSSELLSEAKKLNDSQAPK | 348 |
| Z11348 | VDAKYAKEEAAAWHEIHILPNLTVSQIAAFISKLFDDPSQSSELLSEAKKLNDSQAPK | 349 |
| Z11349 | VDAKYAKEEASAWTEIHLLPNLTIDQMAAFIQKLFDDPSQSSELLSEAKKLNDSQAPK | 350 |
| Z11350 | VDAKYAKEEQSAWYEIHILPNLTVDQIAAFISKLFDDPSQSSELLSEAKKLNDSQAPK | 351 |
| Z11352 | VDAKYAKEEADAWYEIHLLPNLTVNQMAAFISKLFDDPSQSSELLSEAKKLNDSQAPK | 352 |
| Z11353 | VDAKYAKEEQRAWFEIHTLPNLTVNQMAAFISKLFDDPSQSSELLSEAKKLNDSQAPK | 353 |
| Z11354 | VDAKYAKEEAHAWYEIHILPNLTVSQIAAFISKLFDDPSQSSELLSEAKKLNDSQAPK | 354 |
| Z11355 | VDAKYAKEEAAAWREIHSLPNLTTEQMAAFIMKLFDDPSQSSELLSEAKKLNDSQAPK | 355 |
| Z11356 | VDAKYAKEEHQAWTEIHLLPNLTVQQITAFISKLFDDPSQSSELLSEAKKLNDSQAPK | 356 |
| Z11357 | VDAKYAKEERKAWYEIHSLPNLTVSQMAAFISKLFDDPSQSSELLSEAKKLNDSQAPK | 357 |
| Z11358 | VDAKYAKEEAHAWREIHVLPNLTVDQMAAFISKLFDDPSQSSELLSEAKKLNDSQAPK | 358 |
| Z11359 | VDAKYAKEEAKAWTEIHLLPNLTVHQIAAFISKLFDDPSQSSELLSEAKKLNDSQAPK | 359 |
| Z11360 | VDAKYAKEEREAWFEIHKLPNLTVTQMAAFITKLFDDPSQSSELLSEAKKLNDSQAPK | 360 |
| Z11361 | VDAKYAKEEADAWYEIHILPNLTVSQMAAFISKLFDDPSQSSELLSEAKKLNDSQAPK | 361 |
| Z11362 | VDAKYAKEEARAWYEIHILPNLTVNQMAAFITKLFDDPSQSSELLSEAKKLNDSQAPK | 362 |
| Z11363 | VDAKYAKEEREAWFEIHLLPNLTITQMAAFISKLFDDPSQSSELLSEAKKLNDSQAPK | 363 |

FIG. 1L

| Designation | Sequence | SEQ ID NO |
|---|---|---|
| Z11364 | VDAKYAKEERDAWYEIHLLPNLTVTQMSAFISKLFDDPSQSSELLSEAKKLNDSQAPK | 364 |
| Z11365 | VDAKYAKEEHEAWLEIHALPNLTVEQMSAFIIKLYDDPSQSSELLSEAKKLNDSQAPK | 365 |
| Z11366 | VDAKYAKEEREAWFEIHLLPNLTVHQMAAFISKLFDDPSQSSELLSEAKKLNDSQAPK | 366 |
| Z11367 | VDAKYAKEEHQAWTEIHLLPNLTTEQMAAFIQKLFDDPSQSSELLSEAKKLNDSQAPK | 367 |
| Z11368 | VDAKYAKEEARAWYEIHVLPNLTTDQRSAFISKLFDDPSQSSELLSEAKKLNDSQAPK | 368 |
| Z11369 | VDAKYAKEERDAWFEIHTLPNLTVSQMAAFISKLFDDPSQSSELLSEAKKLNDSQAPK | 369 |
| Z11370 | VDAKYAKEERQAWFEIHSLPNLTVTQMAAFISKLFDDPSQSSELLSEAKKLNDSQAPK | 370 |
| Z11371 | VDAKYAKEERQAWWEIHALPNLTAEQVAAFISKLFDDPSQSSELLSEAKKLNDSQAPK | 371 |
| Z11372 | VDAKYAKEEAKAWYEIHTLPNLTVDQISAFIIKLFDDPSQSSELLSEAKKLNDSQAPK | 372 |
| Z11373 | VDAKYAKEEREAWWEIHLLPNLTVDQISAFISKLFDDPSQSSELLSEAKKLNDSQAPK | 373 |
| Z11374 | VDAKYAKEEADAWTEIHSLPNLTVEQMAAFIWKLLDDPSQSSELLSEAKKLNDSQAPK | 374 |
| Z11375 | VDAKYAKEEIRAAWWEIHTLPNLTTDQRSAFIIKLYDDPSQSSELLSEAKKLNDSQAPK | 375 |
| Z11376 | VDAKYAKEEHRAWTEIHLLPNLTTDQMAAFIIKLFDDPSQSSELLSEAKKLNDSQAPK | 376 |
| Z11377 | VDAKYAKEEADAWWEIHMLPNLTTEQRSAFISKLFDDPSQSSELLSEAKKLNDSQAPK | 377 |
| Z11378 | VDAKYAKEEREAWWEIHKLPNLTVEQVAAFISKLFDDPSQSSELLSEAKKLNDSQAPK | 378 |
| Z11379 | VDAKYAKEEAHAWWEIHALPNLTVHQMAAFISKLFDDPSQSSELLSEAKKLNDSQAPK | 379 |
| Z11381 | VDAKYAKEEAQAWREIHVLPNLTVQQIAAFISKLFDDPSQSSELLSEAKKLNDSQAPK | 380 |
| Z11382 | VDAKYAKEERHAWWEIHKLPNLTVEQVAAFISKLFDDPSQSSELLSEAKKLNDSQAPK | 381 |
| Z11383 | VDAKYAKEEAQAWWEIHKLPNLTVEQLAAFISKLFDDPSQSSELLSEAKKLNDSQAPK | 382 |
| Z11385 | VDAKYAKEERKAWYEIHTLPNLTTDQVAAFISKLFDDPSQSSELLSEAKKLNDSQAPK | 383 |
| Z11386 | VDAKYAKEEREAWHEIHLLPNLTIEQMAAFISKLFDDPSQSSELLSEAKKLNDSQAPK | 384 |
| Z11387 | VDAKYAKEEQKAWWEIHLLPNLTVHQMAAFISKLFDDPSQSSELLSEAKKLNDSQAPK | 385 |
| Z11388 | VDAKYAKEEQAAWLEIHLLPNLTVEQMAAFISKLFDDPSQSSELLSEAKKLNDSQAPK | 386 |
| Z11389 | VDAKYAKEEREAWWEIHALPNLTTNQMAAFISKLFDDPSQSSELLSEAKKLNDSQAPK | 387 |
| Z11390 | VDAKYAKEEAEAWYEIHILPNLTITTQMAAFISKLFDDPSQSSELLSEAKKLNDSQAPK | 388 |
| Z11391 | VDAKYAKEERQAWYEIHLLPNLTVDQMAAFISKLFDDPSQSSELLSEAKKLNDSQAPK | 389 |
| Z11392 | VDAKYAKEEAKAWFEIHTLPNLTVTQMAAFISKLFDDPSQSSELLSEAKKLNDSQAPK | 390 |
| Z11393 | VDAKYAKEEADAWWEIHSLPNLTVDQTAAFISKLFDDPSQSSELLSEAKKLNDSQAPK | 391 |
| Z11394 | VDAKYAKEERVAWYEIHILPNLTVEQTAAFISKLFDDPSQSSELLSEAKKLNDSQAPK | 392 |
| Z11395 | VDAKYAKEERKAWYEIHTLPNLTVDQMSAFISKLFDDPSQSSELLSEAKKLNDSQAPK | 393 |
| Z11396 | VDAKYAKEEAQAWFEIHTLPNLTIEQMAAFIIKLYDDPSQSSELLSEAKKLNDSQAPK | 394 |
| Z11397 | VDAKYAKEERQAWYEIHALPNLTVDQMAAFISKLFDDPSQSSELLSEAKKLNDSQAPK | 395 |
| Z11398 | VDAKYAKEEADAWFEIHVLPNLTTEQMTAFISKLFDDPSQSSELLSEAKKLNDSQAPK | 396 |

FIG. 1M

| Designation | Sequence | SEQ ID NO |
|---|---|---|
| Z11399 | VDAKYAKEERRAWFEIHALPNLTVEQMAAFISKLFDDPSQSSELLSEAKKLNDSQAPK | 397 |
| Z11400 | VDAKYAKEEAKAWYEIHSLPNLTVNQMAAFISKLFDDPSQSSELLSEAKKLNDSQAPK | 398 |
| Z11401 | VDAKYAKEEARAWHEIHTLPNLTVHQMAAFIQKLFDDPSQSSELLSEAKKLNDSQAPK | 399 |
| Z11402 | VDAKYAKEERRAWREIHTLPNLTVSQMAAFISKLFDDPSQSSELLSEAKKLNDSQAPK | 400 |
| Z11403 | VDAKYAKEERAAWYEIHLLPNLTISQMAAFISKLFDDPSQSSELLSEAKKLNDSQAPK | 401 |
| Z11404 | VDAKYAKEERKAWWEIHTLPNLTVSQMAAFISKLFDDPSQSSELLSEAKKLNDSQAPK | 402 |
| Z11405 | VDAKYAKEERHAWYEIHMLPNLTIEQITAFISKLFDDPSQSSELLSEAKKLNDSQAPK | 403 |
| Z11406 | VDAKYAKEEAQAWHEIHLLPNLTVEQMAAFIQKLFDDPSQSSELLSEAKKLNDSQAPK | 404 |
| Z11407 | VDAKYAKEERKAWYEIHMLPNLTVDQIAAFISKLFDDPSQSSELLSEAKKLNDSQAPK | 405 |
| Z11408 | VDAKYAKEEAHAWWEIHKLPNLTVEQVAAFISKLFDDPSQSSELLSEAKKLNDSQAPK | 406 |
| Z11409 | VDAKYAKEERKAWWEIHLLPNLTVNQMAAFISKLFDDPSQSSELLSEAKKLNDSQAPK | 407 |
| Z11410 | VDAKYAKEEREAWYEIHLLPNLTVSQMAAFISKLFDDPSQSSELLSEAKKLNDSQAPK | 408 |
| Z11411 | VDAKYAKEEAKAWHEIHILPNLTVDQMAAFIIKLFDDPSQSSELLSEAKKLNDSQAPK | 409 |
| Z11412 | VDAKYAKEERHAWYEIHTLPNLTVEQMAAFISKLFDDPSQSSELLSEAKKLNDSQAPK | 410 |
| Z11413 | VDAKYAKEERHAWTEIHTLPNLTVQQMAAFISKLFDDPSQSSELLSEAKKLNDSQAPK | 411 |
| Z11414 | VDAKYAKEERDAWHEIHTLPNLTVNQMAAFISKLFDDPSQSSELLSEAKKLNDSQAPK | 412 |
| Z11415 | VDAKYAKEEREAWYEIHLLPNLTTNQRSAFISKLFDDPSQSSELLSEAKKLNDSQAPK | 413 |
| Z11416 | VDAKYAKEEAVAWREIHLLPNLTVDQLAAFISKLFDDPSQSSELLSEAKKLNDSQAPK | 414 |
| Z11417 | VDAKYAKEERAAWTEIHLLPNLTVDQIAAFISKLFDDPSQSSELLSEAKKLNDSQAPK | 415 |
| Z11418 | VDAKYAKEEQAAWFEIHVLPNLTIEQRAAFISKLFDDPSQSSELLSEAKKLNDSQAPK | 416 |
| Z11419 | VDAKYAKEERTAWWEIHALPNLTVEQIAAFISKLFDDPSQSSELLSEAKKLNDSQAPK | 417 |
| Z11420 | VDAKYAKEEAEAWFEIHTLPNLTVDQRVAFIIKLFDDPSQSSELLSEAKKLNDSQAPK | 418 |
| Z11421 | VDAKYAKEEREAWFEIHTLPNLTINQMAAFISKLFDDPSQSSELLSEAKKLNDSQAPK | 419 |
| Z11422 | VDAKYAKEERQAWFEIHALPNLTVQQRAAFISKLFDDPSQSSELLSEAKKLNDSQAPK | 420 |
| Z11423 | VDAKYAKEEREAWHEIHLLPNLTIDQLAAFISKLFDDPSQSSELLSEAKKLNDSQAPK | 421 |
| Z11424 | VDAKYAKEEHHAWWEIHALPNLTVDQVAAFIIKLYDDPSQSSELLSEAKKLNDSQAPK | 422 |
| Z11425 | VDAKYAKEEAKAWYEIHILPNLTVTQITAFISKLFDDPSQSSELLSEAKKLNDSQAPK | 423 |
| Z11426 | VDAKYAKEEQQAWFEIHTLPNLTVQQVTAFISKLFDDPSQSSELLSEAKKLNDSQAPK | 424 |
| Z11427 | VDAKYAKEERTAWWEIHTLPNLTVTQMAAFISKLFDDPSQSSELLSEAKKLNDSQAPK | 425 |
| Z11428 | VDAKYAKEERAAWYEIHLLPNLTVDQMSAFIIKLFDDPSQSSELLSEAKKLNDSQAPK | 426 |
| Z11429 | VDAKYAKEEQQAWWEIHALPNLTVDQITAFISKLFDDPSQSSELLSEAKKLNDSQAPK | 427 |
| Z11430 | VDAKYAKEERRAWYEIHTLPNLTVSQMAAFIIKLFDDPSQSSELLSEAKKLNDSQAPK | 428 |
| Z11431 | VDAKYAKEEQRAWTEIHMLPNLTANQMAAFISKLFDDPSQSSELLSEAKKLNDSQAPK | 429 |

FIG. 1N

| Designation | Sequence | SEQ ID NO |
|---|---|---|
| Z11432 | VDAKYAKEEHEAWYEIHVLPNLTVNQISAFISKLFDDPSQSSELLSEAKKLNDSQAPK | 430 |
| Z11434 | VDAKYAKEEADAWHEIHLLPNLTVEQMAAFIQKLFDDPSQSSELLSEAKKLNDSQAPK | 431 |
| Z11435 | VDAKYAKEERAWFEIHALPNLTVTQMAAFISKLFDDPSQSSELLSEAKKLNDSQAPK | 432 |
| Z11436 | VDAKYAKEERDAWYEIHLLPNLTVEQMAAFIQKLFDDPSQSSELLSEAKKLNDSQAPK | 433 |
| Z11437 | VDAKYAKEERKAWFEIHLLPNLTVTQMAAFISKLFDDPSQSSELLSEAKKLNDSQAPK | 434 |
| Z11438 | VDAKYAKEEAEAWSEIHLLPNLTVEQMAAFISKLFDDPSQSSELLSEAKKLNDSQAPK | 435 |
| Z11439 | VDAKYAKEERKAWYEIHSLPNLTVNQMAAFIKLFDDPSQSSELLSEAKKLNDSQAPK | 436 |
| Z11440 | VDAKYAKEEAAAWHEIHVLPNLTVDQMAAFIIKLYDDPSQSSELLSEAKKLNDSQAPK | 437 |
| Z11441 | VDAKYAKEERHAWTEIHKLPNLTIQQITAFISKLFDDPSQSSELLSEAKKLNDSQAPK | 438 |
| Z11442 | VDAKYAKEERRAWFEIHALPNLTVQQMVAFISKLFDDPSQSSELLSEAKKLNDSQAPK | 439 |
| Z11443 | VDAKYAKEERDAWYEIHILPNLTVNQIAAFISKLFDDPSQSSELLSEAKKLNDSQAPK | 440 |
| Z11444 | VDAKYAKEEAEAWHEIHVLPNLTVDQMAAFISKLFDDPSQSSELLSEAKKLNDSQAPK | 441 |
| Z11445 | VDAKYAKEEARAWHEIHLLPNLTIQQMAAFISKLFDDPSQSSELLSEAKKLNDSQAPK | 442 |
| Z11446 | VDAKYAKEEAQAWWEIHALPNLTVDQTAAFIKLFDDPSQSSELLSEAKKLNDSQAPK | 443 |
| Z11447 | VDAKYAKEEADAWFEIHTLPNLTVEQIAAFISKLFDDPSQSSELLSEAKKLNDSQAPK | 444 |
| Z11448 | VDAKYAKEEAAAWYEIHILPNLTVQQMAAFISKLFDDPSQSSELLSEAKKLNDSQAPK | 445 |
| Z11449 | VDAKYAKEEAEAWFEIHVLPNLTVSQIAAFISKLFDDPSQSSELLSEAKKLNDSQAPK | 446 |
| Z11450 | VDAKYAKEEQSAWYEIHLLPNLTTNQLTAFISKLFDDPSQSSELLSEAKKLNDSQAPK | 447 |
| Z11451 | VDAKYAKEEARAWYEIHTLPNLTATQMAAFISKLFDDPSQSSELLSEAKKLNDSQAPK | 448 |
| Z11452 | VDAKYAKEEADAWWEIHALPNLTVDQVTAFITKLFDDPSQSSELLSEAKKLNDSQAPK | 449 |
| Z11453 | VDAKYAKEEAHAWREIHILPNLTVNQMAAFISKLFDDPSQSSELLSEAKKLNDSQAPK | 450 |
| Z11454 | VDAKYAKEEAQAWHEIHLLPNLTVHQMAAFISKLFDDPSQSSELLSEAKKLNDSQAPK | 451 |
| Z11455 | VDAKYAKEEARAWHEIHILPNLTTDQMAAFISKLFDDPSQSSELLSEAKKLNDSQAPK | 452 |
| Z11456 | VDAKYAKEERHAWHEIHILPNLTVDQMAAFISKLFDDPSQSSELLSEAKKLNDSQAPK | 453 |
| Z11457 | VDAKYAKEERHAWREIHALPNLTVNQMAAFISKLFDDPSQSSELLSEAKKLNDSQAPK | 454 |
| Z11458 | VDAKYAKEERTAWWEIHALPNLTVSQVAAFISKLFDDPSQSSELLSEAKKLNDSQAPK | 455 |
| Z11459 | VDAKYAKEERHAWYEIHIHLPNLTVDQMAAFITKLFDDPSQSSELLSEAKKLNDSQAPK | 456 |
| Z11460 | VDAKYAKEEQRAWREIHLLPNLTVDQMAAFISKLFDDPSQSSELLSEAKKLNDSQAPK | 457 |
| Z11461 | VDAKYAKEERQAWYEIHVLPNLTVHQMAAFISKLFDDPSQSSELLSEAKKLNDSQAPK | 458 |
| Z11462 | VDAKYAKEEAQAWHEIHTLPNLTVSQMAAFISKLFDDPSQSSELLSEAKKLNDSQAPK | 459 |
| Z11463 | VDAKYAKEEREAWLEIHLLPNLTIDQMSAFISKLFDDPSQSSELLSEAKKLNDSQAPK | 460 |
| Z11464 | VDAKYAKEEHRAWFEIHLLPNLTTEQMAAFISKLFDDPSQSSELLSEAKKLNDSQAPK | 461 |
| Z11465 | VDAKYAKEERRAWYEIHLLPNLTTDQMAAFISKLFDDPSQSSELLSEAKKLNDSQAPK | 462 |

FIG. 10

| Designation | Sequence | SEQ ID NO |
|---|---|---|
| Z11466 | VDAKYAKEEREAWYEIHILPNLTVSQIAAFISKLFDDPSQSSELLSEAKKLNDSQAPK | 463 |
| Z11467 | VDAKYAKEERDAWYEIHILPNLTVSQMAAFISKLFDDPSQSSELLSEAKKLNDSQAPK | 464 |
| Z11468 | VDAKYAKEERDAWYEIHLLPNLTVSQMAAFISKLFDDPSQSSELLSEAKKLNDSQAPK | 465 |
| Z11469 | VDAKYAKEERTAWFEIHSLPNLTAEQMAAFIIKLYDDPSQSSELLSEAKKLNDSQAPK | 466 |
| Z11470 | VDAKYAKEEHRAWLEIHTLPNLTVDQMAAFISKLFDDPSQSSELLSEAKKLNDSQAPK | 467 |
| Z11471 | VDAKYAKEEHAAWYEIHLLPNLTVSQISAFIQKLFDDPSQSSELLSEAKKLNDSQAPK | 468 |
| Z11473 | VDAKYAKEEADAWYEIHALPNLTVDQMAAFISKLFDDPSQSSELLSEAKKLNDSQAPK | 469 |
| Z11474 | VDAKYAKEEAEAWWEIHTLPNLTVDQMAAFISKLFDDPSQSSELLSEAKKLNDSQAPK | 470 |
| Z11475 | VDAKYAKEEAEAWWEIHKLPNLTVEQMTAFIIKLYDDPSQSSELLSEAKKLNDSQAPK | 471 |
| Z11476 | VDAKYAKEEHHAWREIHILPNLTVEQMAAFIIKLFDDPSQSSELLSEAKKLNDSQAPK | 472 |
| Z11477 | VDAKYAKEEREAWYEIHILPNLTIQQMAAFISKLFDDPSQSSELLSEAKKLNDSQAPK | 473 |
| Z11478 | VDAKYAKEEHAAWLEIHLLPNLTIDQMAAFISKLFDDPSQSSELLSEAKKLNDSQAPK | 474 |
| Z11479 | VDAKYAKEERAAWYEIHLLPNLTIHQMAAFISKLFDDPSQSSELLSEAKKLNDSQAPK | 475 |
| Z11480 | VDAKYAKEERTAWYEIHLLPNLTVHQMAAFISKLFDDPSQSSELLSEAKKLNDSQAPK | 476 |
| Z11481 | VDAKYAKEERHAWHEIHSLPNLTIDQLTAFISKLFDDPSQSSELLSEAKKLNDSQAPK | 477 |
| Z11482 | VDAKYAKEEREAWYEIHSLPNLTVDQVAAFISKLFDDPSQSSELLSEAKKLNDSQAPK | 478 |
| Z11483 | VDAKYAKEEHHAWHEIHTLPNLTVHQMAAFISKLFDDPSQSSELLSEAKKLNDSQAPK | 479 |
| Z11484 | VDAKYAKEEAHAWHEIHLLPNLTVEQAAAFISKLFDDPSQSSELLSEAKKLNDSQAPK | 480 |
| Z11485 | VDAKYAKEEAHAWWEIHLLPNLTVNQVAAFISKLFDDPSQSSELLSEAKKLNDSQAPK | 481 |
| Z11486 | VDAKYAKEEARAWYEIHILPNLTVTQMAAFISKLFDDPSQSSELLSEAKKLNDSQAPK | 482 |
| Z11487 | VDAKYAKEEARAWWEIHLLPNLTVDQISAFISKLFDDPSQSSELLSEAKKLNDSQAPK | 483 |
| Z11488 | VDAKYAKEEHDAWFEIHLLPNLTVEQIAAFISKLFDDPSQSSELLSEAKKLNDSQAPK | 484 |
| Z11489 | VDAKYAKEEHTAWYEIHLLPNLTVDQMAAFISKLFDDPSQSSELLSEAKKLNDSQAPK | 485 |
| Z11490 | VDAKYAKEEREAWWEIHALPNLTVNQMAAFIIKLFDDPSQSSELLSEAKKLNDSQAPK | 486 |
| Z11491 | VDAKYAKEERDAWYEISTLPNLTVEQAAAFISKLFDDPSQSSELLSEAKKLNDSQAPK | 487 |
| Z11492 | VDAKYAKEEREAWYEIHLLPNLTITQMAAFISKLFDDPSQSSELLSEAKKLNDSQAPK | 488 |
| Z11493 | VDAKYAKEEAKAWFEIHTLPNLTVDQVAAFISKLFDDPSQSSELLSEAKKLNDSQAPK | 489 |
| Z11494 | VDAKYAKEERQAWWEIHTLPNLTVEQMSAFISKLYDDPSQSSELLSEAKKLNDSQAPK | 490 |
| Z11495 | VDAKYAKEEHEAWHEIHILPNLTVEQMAAFISKLFDDPSQSSELLSEAKKLNDSQAPK | 491 |
| Z11496 | VDAKYAKEERDAWFEIHLLPNLTVDQMAAFISKLFDDPSQSSELLSEAKKLNDSQAPK | 492 |
| Z11497 | VDAKYAKEEAKAWWEIHLLPNLTVNQMAAFISKLFDDPSQSSELLSEAKKLNDSQAPK | 493 |
| Z11498 | VDAKYAKEEARAWWEIHLLPNLTIDQMAAFISKLFDDPSQSSELLSEAKKLNDSQAPK | 494 |
| Z11499 | VDAKYAKEEQKAWWEIHSLPNLTVDQITAFISKLFDDPSQSSELLSEAKKLNDSQAPK | 495 |

FIG. 1P

| Designation | Sequence | SEQ ID NO |
|---|---|---|
| Z11500 | VDAKYAKEEREAWYEIHLLPNLTVSQIAAFISKLFDDPSQSSELLSEAKKLNDSQAPK | 496 |
| Z11501 | VDAKYAKEERRAWHEIQTLPNLTVRQMAAFISKLFDDPSQSSELLSEAKKLNDSQAPK | 497 |
| Z11502 | VDAKYAKEERQAWYEIHTLPNLTATQMAAFIQKLFDDPSQSSELLSEAKKLNDSQAPK | 498 |
| Z11503 | VDAKYAKEERHAWTEIHLLPNLTVNQMAAFIIKLFDDPSQSSELLSEAKKLNDSQAPK | 499 |
| Z11504 | VDAKYAKEEARAWHEIHVLPNLTVNQMTAFISKLFDDPSQSSELLSEAKKLNDSQAPK | 500 |
| Z11505 | VDAKYAKEEAEAWYEIHLLPNLTVNQIAAFISKLFDDPSQSSELLSEAKKLNDSQAPK | 501 |
| Z11506 | VDAKYAKEEAEAWREIHLLPNLTVDQMAAFISKLFDDPSQSSELLSEAKKLNDSQAPK | 502 |
| Z11507 | VDAKYAKEERSAWFEIHTLPNLTVDQMAAFISKLFDDPSQSSELLSEAKKLNDSQAPK | 503 |
| Z11508 | VDAKYAKEEAQAWYEIHALPNLTVEQMAAFISKLFDDPSQSSELLSEAKKLNDSQAPK | 504 |
| Z11509 | VDAKYAKEERTAWWEIHALPNLTVNQVTAFISKLFDDPSQSSELLSEAKKLNDSQAPK | 505 |
| Z11510 | VDAKYAKEEAEAWFEIHVLPNLTTDQRVAFITKLFDDPSQSSELLSEAKKLNDSQAPK | 506 |
| Z11511 | VDAKYAKEEAEAWYEIHVLPNLTVDQMAAFIQKLFDDPSQSSELLSEAKKLNDSQAPK | 507 |
| Z11512 | VDAKYAKEEREAWLEIHLLPNLTVEQMAAFISKLFDDPSQSSELLSEAKKLNDSQAPK | 508 |
| Z11513 | VDAKYAKEERAAWWEIHSLPNLTVSQMAAFISKLFDDPSQSSELLSEAKKLNDSQAPK | 509 |
| Z11514 | VDAKYAKEEAKAWREIHLLPNLTTDQIAAFIMKLFDDPSQSSELLSEAKKLNDSQAPK | 510 |
| Z11515 | VDAKYAKEERQAWHEIHALPNLTVTQMAAFISKLFDDPSQSSELLSEAKKLNDSQAPK | 511 |
| Z11516 | VDAKYAKEERDAWFEIHTLPNLTVDQMAAFIQKLFDDPSQSSELLSEAKKLNDSQAPK | 512 |
| Z11517 | VDAKYAKEERRAWYEIHSLPNLTVNQMAAFIIKLFDDPSQSSELLSEAKKLNDSQAPK | 513 |
| Z11518 | VDAKYAKEEHQAWHEIHLLPNLTVSQMAAFIQKLFDDPSQSSELLSEAKKLNDSQAPK | 514 |
| Z11519 | VDAKYAKEEAEAWLEIHLLPNLTTDQIAAFISKLFDDPSQSSELLSEAKKLNDSQAPK | 515 |
| Z11520 | VDAKYAKEEAHAWHEIHLLPNLTIDQMAAFIMKLFDDPSQSSELLSEAKKLNDSQAPK | 516 |
| Z11521 | VDAKYAKEERAAWYEIHLLPNLTIEQMSAFISKLFDDPSQSSELLSEAKKLNDSQAPK | 517 |
| Z11522 | VDAKYAKEEAKAWFEIHALPNLTTTQMAAFISKLFDDPSQSSELLSEAKKLNDSQAPK | 518 |
| Z11523 | VDAKYAKEERHAWTEIHILPNLTVDQMAAFISKLFDDPSQSSELLSEAKKLNDSQAPK | 519 |
| Z11524 | VDAKYAKEERQAWHEIHILPNLTITQRTAFISKLFDDPSQSSELLSEAKKLNDSQAPK | 520 |
| Z11525 | VDAKYAKEERRAWYEIHTLPNLTITQMAAFIQKLFDDPSQSSELLSEAKKLNDSQAPK | 521 |
| Z11526 | VDAKYAKEEAEAWLEIHLLPNLTVSQMAAFIWKLFDDPSQSSELLSEAKKLNDSQAPK | 522 |
| Z11527 | VDAKYAKEEAHAWWEIHALPNLTTNQMAAFISKLFDDPSQSSELLSEAKKLNDSQAPK | 523 |
| Z11528 | VDAKYAKEERHAWTEIHKLPNLTVRQMAAFISKLFDDPSQSSELLSEAKKLNDSQAPK | 524 |
| Z11529 | VDAKYAKEERQAWTEIHLLPNLTINQMVAFIIKLFDDPSQSSELLSEAKKLNDSQAPK | 525 |
| Z11530 | VDAKYAKEEAHAWHEIHILPNLTVDQMAAFISKLFDDPSQSSELLSEAKKLNDSQAPK | 526 |
| Z11531 | VDAKYAKEERQAWHEIHTLPNLTVNQMAAFISKLFDDPSQSSELLSEAKKLNDSQAPK | 527 |
| Z11532 | VDAKYAKEERHAWWEIHKLPNLTVNQMAAFISKLFDDPSQSSELLSEAKKLNDSQAPK | 528 |

FIG. 1Q

| Designation | Sequence | SEQ ID NO |
|---|---|---|
| Z11533 | VDAKYAKEEAKAWFEIHKLPNLTANQMAAFIIKLYDDPSQSSELLSEAKKLNDSQAPK | 529 |
| Z11534 | VDAKYAKEEREAWYEIHILPNLTVQQRVAFISKLFDDPSQSSELLSEAKKLNDSQAPK | 530 |
| Z11535 | VDAKYAKEEQEAWHEIHILPNLTVTQMTAFISKLFDDPSQSSELLSEAKKLNDSQAPK | 531 |
| Z11536 | VDAKYAKEERQAWFEIHVLPNLTIEQMAAFISKLFDDPSQSSELLSEAKKLNDSQAPK | 532 |
| Z11537 | VDAKYAKEERQAWYEIHKLPNLTVSQMTAFISKLFDDPSQSSELLSEAKKLNDSQAPK | 533 |
| Z11538 | VDAKYAKEEREAWWEIHLLPNLTIDQMAAFIQKLFDDPSQSSELLSEAKKLNDSQAPK | 534 |
| Z11539 | VDAKYAKEEERDAWYEIHTLPNLTVHQMAAFISKLFDDPSQSSELLSEAKKLNDSQAPK | 535 |
| Z11540 | VDAKYAKEEQAAWFEIHALPNLTVSQMAAFISKLFDDPSQSSELLSEAKKLNDSQAPK | 536 |
| Z11541 | VDAKYAKEEAHAWYEIHILPNLTVRQIAAFIQKLFDDPSQSSELLSEAKKLNDSQAPK | 537 |
| Z11542 | VDAKYAKEEAKAWWEIHSLPNLTAEQVSAFIQKLFDDPSQSSELLSEAKKLNDSQAPK | 538 |
| Z11543 | VDAKYAKEEQKAWHEIHILPNLTTHQRVAFISKLFDDPSQSSELLSEAKKLNDSQAPK | 539 |
| Z11544 | VDAKYAKEERQAWYEIHALPNLTVTQMAAFISKLFDDPSQSSELLSEAKKLNDSQAPK | 540 |
| Z11545 | VDAKYAKEEERDAWYEIHILPNLTVSQMSAFIQKLFDDPSQSSELLSEAKKLNDSQAPK | 541 |
| Z11546 | VDAKYAKEEHDAWYEIHLLPNLTVQQMAAFISKLFDDPSQSSELLSEAKKLNDSQAPK | 542 |
| Z11547 | VDAKYAKEEAHAWREIHLLPNLTVHQRTAFISKLFDDPSQSSELLSEAKKLNDSQAPK | 543 |
| Z11548 | VDAKYAKEERHAWREIHLLPNLTHTQMAAFISKLFDDPSQSSELLSEAKKLNDSQAPK | 544 |
| Z11549 | VDAKYAKEERHAWYEIHVLPNLTIQQMAAFIQKLFDDPSQSSELLSEAKKLNDSQAPK | 545 |
| Z11550 | VDAKYAKEERKAWYEIHILPNLTTNQMAAFISKLFDDPSQSSELLSEAKKLNDSQAPK | 546 |
| Z11551 | VDAKYAKEEERDAWREIHLLPNLTVRQLSAFISKLFDDPSQSSELLSEAKKLNDSQAPK | 547 |
| Z11553 | VDAKYAKEERQAWYEIHLLPNLTTQQMAAFIQKLFDDPSQSSELLSEAKKLNDSQAPK | 548 |
| Z11554 | VDAKYAKEERKAWREIHTLPNLTVQQMAAFISKLFDDPSQSSELLSEAKKLNDSQAPK | 549 |
| Z11555 | VDAKYAKEERHAWLEIHKLPNLTITATQMAAFISKLFDDPSQSSELLSEAKKLNDSQAPK | 550 |
| Z11556 | VDAKYAKEEREAWYEIHVLPNLTVEQMVAFISKLFDDPSQSSELLSEAKKLNDSQAPK | 551 |
| Z11557 | VDAKYAKEERQAWFEIHTLPNLTVDQMVAFISKLFDDPSQSSELLSEAKKLNDSQAPK | 552 |
| Z11558 | VDAKYAKEEARAWYEIHSLPNLTVDQMSAFIIKLYDDPSQSSELLSEAKKLNDSQAPK | 553 |
| Z11559 | VDAKYAKEEAHAWWEIHLLPNLTVHQIAAFISKLFDDPSQSSELLSEAKKLNDSQAPK | 554 |
| Z11560 | VDAKYAKEEAQAWHEIHILPNLTIQQIAAFIQKLFDDPSQSSELLSEAKKLNDSQAPK | 555 |
| Z11561 | VDAKYAKEEQDAWWEIHKLPNLTVNQMAAFISKLYDDPSQSSELLSEAKKLNDSQAPK | 556 |
| Z11562 | VDAKYAKEEERAAWHEIHLLPNLTISQMAAFISKLFDDPSQSSELLSEAKKLNDSQAPK | 557 |
| Z11563 | VDAKYAKEERQAWFEIHVLPNLTIHQIAAFISKLFDDPSQSSELLSEAKKLNDSQAPK | 558 |
| Z11564 | VDAKYAKEEREAWWEIHALPNLTANQMAAFITTQMAAFISKLFDDPSQSSELLSEAKKLNDSQAPK | 559 |
| Z11565 | VDAKYAKEEATAWHEIHLLPNLTITTQMAAFISKLFDDPSQSSELLSEAKKLNDSQAPK | 560 |
| Z11566 | VDAKYAKEERKAWFEIHLLPNLTISQMTAFISKLFDDPSQSSELLSEAKKLNDSQAPK | 561 |

FIG. 1R

| Designation | Sequence | SEQ ID NO |
|---|---|---|
| Z11567 | VDAKYAKEEAKAWFEIHALPNLTIQQMAAFISKLFDDPSQSSELLSEAKKLNDSQAPK | 562 |
| Z11568 | VDAKYAKEEARAWHEIHILPNLTTQQMAAFISKLFDDPSQSSELLSEAKKLNDSQAPK | 563 |
| Z11569 | VDAKYAKEEAQAWYEIHLLPNLTVSQIAAFIVKLYDDPSQSSELLSEAKKLNDSQAPK | 564 |
| Z11570 | VDAKYAKEERHAWFEIHKLPNLTVDQVSAFIIKLYDDPSQSSELLSEAKKLNDSQAPK | 565 |
| Z11571 | VDAKYAKEERQAWYEIHVLPNLTVSQMTAFISKLFDDPSQSSELLSEAKKLNDSQAPK | 566 |
| Z11572 | VDAKYAKEEADAWHEIHLLPNLTIDQMAAFISKLFDDPSQSSELLSEAKKLNDSQAPK | 567 |
| Z11573 | VDAKYAKEEASAWREIHILPNLTVNQMAAFISKLFDDPSQSSELLSEAKKLNDSQAPK | 568 |
| Z11574 | VDAKYAKEEAQAWYEIHILPNLTVDQMAAFISKLFDDPSQSSELLSEAKKLNDSQAPK | 569 |
| Z11575 | VDAKYAKEERSAWYEIHILPNLTVHQMTAFISKLFDDPSQSSELLSEAKKLNDSQAPK | 570 |
| Z11576 | VDAKYAKEEATAWREIHLLPNLTVEQMAAFISKLFDDPSQSSELLSEAKKLNDSQAPK | 571 |
| Z11577 | VDAKYAKEERTAWYEIHILPNLTVEQMTAFIQKLFDDPSQSSELLSEAKKLNDSQAPK | 572 |
| Z11578 | VDAKYAKEEAHAWHEIHIIPNLTVDQVVAFISKLFDDPSQSSELLSEAKKLNDSQAPK | 573 |
| Z11579 | VDAKYAKEERRAWYEIHLLPNLTVEQMAAFISKLFDDPSQSSELLSEAKKLNDSQAPK | 574 |
| Z11580 | VDAKYAKEERKAWYEIHLLPNLTVSQMTAFISKLFDDPSQSSELLSEAKKLNDSQAPK | 575 |
| Z11581 | VDAKYAKEERRAWFEIHSLPNLTVRQIAAFIIKLFDDPSQSSELLSEAKKLNDSQAPK | 576 |
| Z11582 | VDAKYAKEERQAWTEIHVLPNLTVNQMAAFISKLFDDPSQSSELLSEAKKLNDSQAPK | 577 |
| Z11583 | VDAKYAKEEAHAWYEIHILPNLTIQQMAAFISKLFDDPSQSSELLSEAKKLNDSQAPK | 578 |
| Z11584 | VDAKYAKEERSAWYEIHLLPNLTVDQMTAFIQKLFDDPSQSSELLSEAKKLNDSQAPK | 579 |
| Z11585 | VDAKYAKEERRAWWEIHTLPNLTVDQMVAFISKLFDDPSQSSELLSEAKKLNDSQAPK | 580 |
| Z11586 | VDAKYAKEERAAWFEIHMLPNLTVEQMAAFISKLFDDPSQSSELLSEAKKLNDSQAPK | 581 |
| Z11587 | VDAKYAKEERTAWYEIHALPNLTVDQMVAFISKLFDDPSQSSELLSEAKKLNDSQAPK | 582 |
| Z11588 | VDAKYAKEERQAWWEIHALPNLTVSQMAAFISKLFDDPSQSSELLSEAKKLNDSQAPK | 583 |
| Z11589 | VDAKYAKEERAAWYEIHLLPNLTVEQMAAFISKLFDDPSQSSELLSEAKKLNDSQAPK | 584 |
| Z11590 | VDAKYAKEEAAAWWEIHMLPNLTIDQMTAFISKLFDDPSQSSELLSEAKKLNDSQAPK | 585 |
| Z11591 | VDAKYAKEERRAWFEIHSLPNLTVRQMAAFISKLFDDPSQSSELLSEAKKLNDSQAPK | 586 |
| Z11592 | VDAKYAKEERHAWWEIHLLPNLTVDQMVAFISKLFDDPSQSSELLSEAKKLNDSQAPK | 587 |
| Z11593 | VDAKYAKEERKAWWEIHLLPNLTVTQIAAFISKLFDDPSQSSELLSEAKKLNDSQAPK | 588 |
| Z11594 | VDAKYAKEERRAWFEIHSLPNLTVHQMTAFISKLFDDPSQSSELLSEAKKLNDSQAPK | 589 |
| Z11595 | VDAKYAKEEAAAWWEIHMLPNLTVSQMAAFISKLFDDPSQSSELLSEAKKLNDSQAPK | 590 |
| Z11596 | VDAKYAKEEAKAWHEIHLLPNLTVHQMAAFISKLFDDPSQSSELLSEAKKLNDSQAPK | 591 |
| Z11597 | VDAKYAKEERKAWTEIHLLPNLTVEQMAAFIIKLFDDPSQSSELLSEAKKLNDSQAPK | 592 |
| Z11598 | VDAKYAKEEREAWFEIHVLPNLTIRQMAAFISKLFDDPSQSSELLSEAKKLNDSQAPK | 593 |
| Z11599 | VDAKYAKEEREAWYEIHALPNLTVQQMSAFISKLFDDPSQSSELLSEAKKLNDSQAPK | 594 |

FIG. 1S

| Designation | Sequence | SEQ ID NO |
|---|---|---|
| Z11600 | VDAKYAKEERQAWFEIHTLPNLTANQMAAFIIKLYDDPSQSSELLSEAKKLNDSQAPK | 595 |
| Z11601 | VDAKYAKEERHAWYEIHTLPNLTVQQMAAFISKLFDDPSQSSELLSEAKKLNDSQAPK | 596 |
| Z11602 | VDAKYAKEERRAWYEIHLLPNLTVNQMVAFISKLFDDPSQSSELLSEAKKLNDSQAPK | 597 |
| Z11603 | VDAKYAKEERHAWYEIHLLPNLTVEQMAAFISKLFDDPSQSSELLSEAKKLNDSQAPK | 598 |
| Z11604 | VDAKYAKEERKAWYEIHLLPNLTVHQMAAFISKLFDDPSQSSELLSEAKKLNDSQAPK | 599 |
| Z11605 | VDAKYAKEERSAWWEIHTLPNLTVDQMVAFISKLFDDPSQSSELLSEAKKLNDSQAPK | 600 |
| Z11606 | VDAKYAKEEARAWFEIHTLPNLTVDQMAAFISKLFDDPSQSSELLSEAKKLNDSQAPK | 601 |
| Z11607 | VDAKYAKEERRAWYEIHSLPNLTVTQMVAFISKLFDDPSQSSELLSEAKKLNDSQAPK | 602 |
| Z11608 | VDAKYAKEEARAWHEIHVLPNLTVEQMTAFIIKLFDDPSQSSELLSEAKKLNDSQAPK | 603 |
| Z11609 | VDAKYAKEERDAWYEIHLLPNLTIDQMAAFIQKLFDDPSQSSELLSEAKKLNDSQAPK | 604 |
| Z11610 | VDAKYAKEEREAWWEIHLLPNLTIRQMAAFISKLFDDPSQSSELLSEAKKLNDSQAPK | 605 |
| Z11618 | VDAKYAKEEQQAWYEIHLLPNLTVQQRSAFISKLFDDPSQSSELLSEAKKLNDSQAPK | 606 |
| Z11619 | VDAKYAKEERDAWWEIHALPNLTVNQMAAFISKLFDDPSQSSELLSEAKKLNDSQAPK | 607 |
| Z11620 | VDAKYAKEEARAWYEIHILPNLTVTQMAAFIQKLFDDPSQSSELLSEAKKLNDSQAPK | 608 |
| Z11621 | VDAKYAKEERVAWYEIHMLPNLTVSQMAAFISKLFDDPSQSSELLSEAKKLNDSQAPK | 609 |
| Z11622 | VDAKYAKEERTAWWEIHALPNLTVQQRSAFISKLFDDPSQSSELLSEAKKLNDSQAPK | 610 |
| Z11623 | VDAKYAKEEAKAWYEIHLLPNLTVRQMAAFISKLFDDPSQSSELLSEAKKLNDSQAPK | 611 |
| Z11624 | VDAKYAKEEAKAWYEIHLLPNLTVRQMAAFIWKLLDDPSQSSELLSEAKKLNDSQAPK | 612 |
| Z11625 | VDAKYAKEERQAWYEIHTLPNLTIDQMSAFISKLFDDPSQSSELLSEAKKLNDSQAPK | 613 |
| Z11626 | VDAKYAKEERKAWWEIHKLPNLTVTQMAAFISKLFDDPSQSSELLSEAKKLNDSQAPK | 614 |
| Z11627 | VDAKYAKEEAHAWYEIHALPNLTVEQMAAFIQKLFDDPSQSSELLSEAKKLNDSQAPK | 615 |
| Z11628 | VDAKYAKEEAHAWREIHLLPNLTVQQIAAFISKLFDDPSQSSELLSEAKKLNDSQAPK | 616 |
| Z11629 | VDAKYAKEERHAWHEIHILPNLTVQQMAAFISKLFDDPSQSSELLSEAKKLNDSQAPK | 617 |
| Z11630 | VDAKYAKEERDAWFEIHALPNLTANQMAAFISKLFDDPSQSSELLSEAKKLNDSQAPK | 618 |
| Z11631 | VDAKYAKEEAKAWYEIHLLPNLTVNQMAAFISKLFDDPSQSSELLSEAKKLNDSQAPK | 619 |
| Z11633 | VDAKYAKEERDAWFEIHSLPNLTVSQMAAFISKLFDDPSQSSELLSEAKKLNDSQAPK | 620 |
| Z11634 | VDAKYAKEERKAWWEIHVLPNLTVDQMAAFISKLFDDPSQSSELLSEAKKLNDSQAPK | 621 |
| Z11635 | VDAKYAKEEAHAWYEIHTLPNLTVRQMAAFISKLFDDPSQSSELLSEAKKLNDSQAPK | 622 |
| Z11636 | VDAKYAKEEARAWREIHTLPNLTVNQMAAFISKLFDDPSQSSELLSEAKKLNDSQAPK | 623 |
| Z11637 | VDAKYAKEERRAWTEIHLLPNLTVEQMAAFISKLFDDPSQSSELLSEAKKLNDSQAPK | 624 |
| Z11638 | VDAKYAKEEAHAWHEIHTLPNLTIDQMVAFISKLFDDPSQSSELLSEAKKLNDSQAPK | 625 |
| Z11639 | VDAKYAKEERQAWYEIHLLPNLTVHQMAAFISKLFDDPSQSSELLSEAKKLNDSQAPK | 626 |
| Z11640 | VDAKYAKEERRAWWEIHLLPNLTVRQMAAFISKLFDDPSQSSELLSEAKKLNDSQAPK | 627 |

FIG. 1T

| Designation | Sequence | SEQ ID NO |
|---|---|---|
| Z11641 | VDAKYAKEEAHAWTEIHKLPNLTVDQMTAFIIKLYDDPSQSSELLSEAKKLNDSQAPK | 628 |
| Z11643 | VDAKYAKEEARAWREIHLLPNLTVTQMAAFISKLFDDPSQSSELLSEAKKLNDSQAPK | 629 |
| Z11645 | VDAKYAKEERQAWWEIHSLPNLTIEQMVAFISKLFDDPSQSSELLSEAKKLNDSQAPK | 630 |
| Z11646 | VDAKYAKEERDAWYEIHLLPNLTIQQMAAFIQKLFDDPSQSSELLSEAKKLNDSQAPK | 631 |
| Z11647 | VDAKYAKEERTAWWEIHLLPNLTVTQMAAFISKLFDDPSQSSELLSEAKKLNDSQAPK | 632 |
| Z11648 | VDAKYAKEERDAWYEIHILPNLTIEQMAAFISKLFDDPSQSSELLSEAKKLNDSQAPK | 633 |
| Z11649 | VDAKYAKEEREAWWEIHSLPNLTAHQMAAFIIKLFDDPSQSSELLSEAKKLNDSQAPK | 634 |
| Z11650 | VDAKYAKEERKAWYEIHSLPNLTVSQMSAFISKLFDDPSQSSELLSEAKKLNDSQAPK | 635 |
| Z11651 | VDAKYAKEERHAWFEIHALPNLTVSQMVAFISKLFDDPSQSSELLSEAKKLNDSQAPK | 636 |
| Z11652 | VDAKYAKEERHAWREIHLLPNLTTEQMSAFIQKLFDDPSQSSELLSEAKKLNDSQAPK | 637 |
| Z11653 | VDAKYAKEEHRAWTEIHLLPNLTVDQMAAFIISKLFDDPSQSSELLSEAKKLNDSQAPK | 638 |
| Z11654 | VDAKYAKEERDAWYEIHLLPNLTTQQRAAFIVKLFDDPSQSSELLSEAKKLNDSQAPK | 639 |
| Z11655 | VDAKYAKEEAQAWWEIHALPNLTVSQMVAFIMKLFDDPSQSSELLSEAKKLNDSQAPK | 640 |
| Z11656 | VDAKYAKEEREAWWEIHALPNLTVNQVVAFISKLFDDPSQSSELLSEAKKLNDSQAPK | 641 |
| Z11657 | VDAKYAKEERQAWYEIHVLPNLTVNQMAAFISKLFDDPSQSSELLSEAKKLNDSQAPK | 642 |
| Z11658 | VDAKYAKEERSAWYEIHLLPNLTVHQMTAFISKLFDDPSQSSELLSEAKKLNDSQAPK | 643 |
| Z11659 | VDAKYAKEEAKAWYEIHILPNLTVHQIAAFISKLFDDPSQSSELLSEAKKLNDSQAPK | 644 |
| Z11660 | VDAKYAKEEQQAWLEIHTLPNLTVSQMQMAAFISKLFDDPSQSSELLSEAKKLNDSQAPK | 645 |
| Z11661 | VDAKYAKEERAAWFEIHLLPNLTVEQMTAFIHKLYDDPSQSSELLSEAKKLNDSQAPK | 646 |
| Z11662 | VDAKYAKEEAHAWREIHLLPNLTVTQMAAFISKLFDDPSQSSELLSEAKKLNDSQAPK | 647 |
| Z11663 | VDAKYAKEEQQAWYEIHLLPNLTITQMAAFIQKLFDDPSQSSELLSEAKKLNDSQAPK | 648 |
| Z11664 | VDAKYAKEERDAWYEIHTLPNLTIHLLPNLTVTQVVAFISKLFDDPSQSSELLSEAKKLNDSQAPK | 649 |
| Z11665 | VDAKYAKEEAHAWYEIHVLPNLTVSQIAAFISKLFDDPSQSSELLSEAKKLNDSQAPK | 650 |
| Z11666 | VDAKYAKEERRAWWEIHALPNLTVSQMVAFISKLFDDPSQSSELLSEAKKLNDSQAPK | 651 |
| Z11667 | VDAKYAKEEAQAWYEIHTLPNLTVHQMAAFISKLFDDPSQSSELLSEAKKLNDSQAPK | 652 |
| Z11668 | VDAKYAKEERAAWFEIHLLPNLTVEQMTAFIHKLYDDPSQSSELLSEAKKLNDSQAPK | 653 |
| Z11669 | VDAKYAKEEAHAWREIHLLPNLTITQMAAFIQKLFDDPSQSSELLSEAKKLNDSQAPK | 654 |
| Z11670 | VDAKYAKEEARAWHEIHVLPNLTVSQIAAFISKLFDDPSQSSELLSEAKKLNDSQAPK | 655 |
| Z11671 | VDAKYAKEEAKAWHEIHVLPNLTVSQIAAFISKLFDDPSQSSELLSEAKKLNDSQAPK | 656 |
| Z11672 | VDAKYAKEEHRAWYEIHLLPNLTINQMAAFIVKLFDDPSQSSELLSEAKKLNDSQAPK | 657 |
| Z11673 | VDAKYAKEEAHAWTEIHKLPNLTVRQMVAFISKLFDDPSQSSELLSEAKKLNDSQAPK | 658 |
| Z11675 | VDAKYAKEERTAWYEIHLLPNLTIQQMAAFISKLFDDPSQSSELLSEAKKLNDSQAPK | 659 |
| Z11676 | VDAKYAKEERKAWYEIHLLPNLTIQQIAAFISKLFDDPSQSSELLSEAKKLNDSQAPK | 660 |

FIG. 1U

| Designation | Sequence | SEQ ID NO |
|---|---|---|
| Z11677 | VDAKYAKEEREAWHEIHLLPNLTVTQMAAFIIKLFDDPSQSSELLSEAKKLNDSQAPK | 661 |
| Z11678 | VDAKYAKEEARAWWEIHLLPNLTVEQMAAFISKLFDDPSQSSELLSEAKKLNDSQAPK | 662 |
| Z11679 | VDAKYAKEERQAWWEIHLLPNLTVTQMAAFISKLFDDPSQSSELLSEAKKLNDSQAPK | 663 |
| Z11680 | VDAKYAKEEAQAWREIHTLPNLTANQMAAFIIKLYDDPSQSSELLSEAKKLNDSQAPK | 664 |
| Z11681 | VDAKYAKEERHAWTEIHLLPNLTISQMAAFISKLFDDPSQSSELLSEAKKLNDSQAPK | 665 |
| Z11682 | VDAKYAKEEARAWWEIHMLPNLTVTQMAAFISKLFDDPSQSSELLSEAKKLNDSQAPK | 666 |
| Z11683 | VDAKYAKEEREAWWEIHLLPNLTAEQMAAFISKLFDDPSQSSELLSEAKKLNDSQAPK | 667 |
| Z11684 | VDAKYAKEEATAWWEIHLLPNLTVTQMAAFIQKLFDDPSQSSELLSEAKKLNDSQAPK | 668 |
| Z11685 | VDAKYAKEEAKAWHEIHLLPNLTVNQMAAFISKLFDDPSQSSELLSEAKKLNDSQAPK | 669 |
| Z11686 | VDAKYAKEERRAWYEIHLLPNLTITQMTAFISKLFDDPSQSSELLSEAKKLNDSQAPK | 670 |
| Z11687 | VDAKYAKEERRAWYEIHLLPNLTVHQIAAFISKLFDDPSQSSELLSEAKKLNDSQAPK | 671 |
| Z11688 | VDAKYAKEIHEAWWEIHLLPNLTVTQMAAFISKLFDDPSQSSELLSEAKKLNDSQAPK | 672 |
| Z11689 | VDAKYAKEERKAWTEIHSLPNLTVDQMSAFIIKLFDDPSQSSELLSEAKKLNDSQAPK | 673 |
| Z11690 | VDAKYAKEEAKAWFEIHLLPNLTINQMAAFISKLFDDPSQSSELLSEAKKLNDSQAPK | 674 |
| Z11691 | VDAKYAKEERDAWYEIHVLPNLTVPNLTIEQMSAFISKLFDDPSQSSELLSEAKKLNDSQAPK | 675 |
| Z11692 | VDAKYAKEEAHAWWEIHALPNLTVTQMAAFISKLFDDPSQSSELLSEAKKLNDSQAPK | 676 |
| Z11693 | VDAKYAKEEAKAWYEIHLLPNLTVTQMAAFIKLFDDPSQSSELLSEAKKLNDSQAPK | 677 |
| Z11694 | VDAKYAKEERDAWWEIHKLPNLTVSQMAAFIQKLFDDPSQSSELLSEAKKLNDSQAPK | 678 |
| Z11695 | VDAKYAKEERDAWYEIHLLPNLTVRQMAAFISKLFDDPSQSSELLSEAKKLNDSQAPK | 679 |
| Z11696 | VDAKYAKEEERAAWWEIHLLPNLTVQQMAAFISKLFDDPSQSSELLSEAKKLNDSQAPK | 680 |
| Z11697 | VDAKYAKEEQQAWYEIHLLPNLTVTQMAAFIIKLFDDPSQSSELLSEAKKLNDSQAPK | 681 |
| Z11699 | VDAKYAKEEADAWFEIHILPNLTIDQMAAFIQKLFDDPSQSSELLSEAKKLNDSQAPK | 682 |
| Z11700 | VDAKYAKEEREAWHEIHTLPNLTVSQMAAFIWKLFDDPSQSSELLSEAKKLNDSQAPK | 683 |
| Z11701 | VDAKYAKEEATAWFEIHTLPNLTVSQMAAFISKLFDDPSQSSELLSEAKKLNDSQAPK | 684 |
| Z11702 | VDAKYAKEEAAAWHEIHILPNLTHHQMAAFIQKLFDDPSQSSELLSEAKKLNDSQAPK | 685 |
| Z11703 | VDAKYAKEEDAWFEIHALPNLTVNQMAAFIIKLYDDPSQSSELLSEAKKLNDSQAPK | 686 |
| Z11704 | VDAKYAKEERKAWYEIHLLPNLTTSQHAAFISKLFDDPSQSSELLSEAKKLNDSQAPK | 687 |
| Z11705 | VDAKYAKEERDAWYEIHLLPNLTVRQMAAFIIKLFDDPSQSSELLSEAKKLNDSQAPK | 688 |
| Z11706 | VDAKYAKEEAVAWHEIHALPNLTVDQMAAFISKLFDDPSQSSELLSEAKKLNDSQAPK | 689 |
| Z11707 | VDAKYAKEEAAAWWEIHALPNLTIEQMVAAFISKLFDDPSQSSELLSEAKKLNDSQAPK | 690 |
| Z11708 | VDAKYAKEEAKAWFEIHALPNLTVQQMAAFIQKLFDDPSQSSELLSEAKKLNDSQAPK | 691 |
| Z11709 | VDAKYAKEEAAAWWEIHSLPNLTVSQMAAFIWKLFDDPSQSSELLSEAKKLNDSQAPK | 692 |
| Z11710 | VDAKYAKEEAKAWHEIHTLPNLTVDQMAAFISKLFDDPSQSSELLSEAKKLNDSQAPK | 693 |

FIG. 1V

| Designation | Sequence | SEQ ID NO |
|---|---|---|
| Z11712 | VDAKYAKEEAQAWWEIHTLPNLTVNQIAAFISKLFDDPSQSSELLSEAKKLNDSQAPK | 694 |
| Z11713 | VDAKYAKEERSAWFEIHVLPNLTIRQMSAFISKLFDDPSQSSELLSEAKKLNDSQAPK | 695 |
| Z11714 | VDAKYAKEERRAWLEIHLLPNLTVTQMTAFISKLFDDPSQSSELLSEAKKLNDSQAPK | 696 |
| Z11715 | VDAKYAKEERAAWFEIHLLPNLTATQIAAFISKLFDDPSQSSELLSEAKKLNDSQAPK | 697 |
| Z11716 | VDAKYAKEERAAWHEIHVLPNLTIHQMAAFISKLFDDPSQSSELLSEAKKLNDSQAPK | 698 |
| Z11717 | VDAKYAKEEARAWYEIHTLPNLTIHQMAAFIQKLFDDPSQSSELLSEAKKLNDSQAPK | 699 |
| Z11718 | VDAKYAKEEAEAWFEIHALPNLTVHQMAAFISKLFDDPSQSSELLSEAKKLNDSQAPK | 700 |
| Z11719 | VDAKYAKEERAAWYEIHSLPNLTTNQMAAFISKLFDDPSQSSELLSEAKKLNDSQAPK | 701 |
| Z11720 | VDAKYAKEEAKAWHEIHVLPNLTIEQRAAFISKLFDDPSQSSELLSEAKKLNDSQAPK | 702 |
| Z11721 | VDAKYAKEERTAWYEIHVLPNLTATQMAAFISKLFDDPSQSSELLSEAKKLNDSQAPK | 703 |
| Z11722 | VDAKYAKEERRAWWEIHLLPNLTVDQMSAFISKLFDDPSQSSELLSEAKKLNDSQAPK | 704 |
| Z11724 | VDAKYAKEEADAWREIHLLPNLTVTQIAAFISKLFDDPSQSSELLSEAKKLNDSQAPK | 705 |
| Z11725 | VDAKYAKEERDAWFEIHVLPNLTTEQMVAFISKLFDDPSQSSELLSEAKKLNDSQAPK | 706 |
| Z11726 | VDAKYAKEEQQAWYEIHVLPNLTVSQMAAFISKLFDDPSQSSELLSEAKKLNDSQAPK | 707 |
| Z11727 | VDAKYAKEERRAWFEIHALPNLTVNQMVAFISKLFDDPSQSSELLSEAKKLNDSQAPK | 708 |
| Z11728 | VDAKYAKEERKAWFEIHSLPNLTATQMHAFISKLFDDPSQSSELLSEAKKLNDSQAPK | 709 |
| Z11729 | VDAKYAKEEQQAWLEIHLLPNLTVEQMTAFIHKLYDDPSQSSELLSEAKKLNDSQAPK | 710 |
| Z11730 | VDAKYAKEEAEAWLEIHLLPNLTVHQMAAFISKLFDDPSQSSELLSEAKKLNDSQAPK | 711 |
| Z11731 | VDAKYAKEERDAWHEIHLLPNLTINQMTAFISKLFDDPSQSSELLSEAKKLNDSQAPK | 712 |
| Z11732 | VDAKYAKEERRAWYEIHTLPNLTVHQMTAFIQKLLDDPSQSSELLSEAKKLNDSQAPK | 713 |
| Z11733 | VDAKYAKEEARAWHEIHLLPNLTVDQTTAFISKLFDDPSQSSELLSEAKKLNDSQAPK | 714 |
| Z11734 | VDAKYAKEERQAWREIHTLPNLTVHQMAAFISKLFDDPSQSSELLSEAKKLNDSQAPK | 715 |
| Z11735 | VDAKYAKEEHDAWREIHTLPNLTVSQMAAFISKLFDDPSQSSELLSEAKKLNDSQAPK | 716 |
| Z11736 | VDAKYAKEERAAWWEIHLLPNLTVHQMSQAFISKLFDDPSQSSELLSEAKKLNDSQAPK | 717 |
| Z11737 | VDAKYAKEEAKAWHEIHALPNLTVSQMAAFISKLFDDPSQSSELLSEAKKLNDSQAPK | 718 |
| Z11738 | VDAKYAKEEAAWWEIHTLPNLTVDQMAAFISKLFDDPSQSSELLSEAKKLNDSQAPK | 719 |
| Z11739 | VDAKYAKEERQAWFEIHKLPNLTVNQMAAFISKLFDDPSQSSELLSEAKKLNDSQAPK | 720 |
| Z11740 | VDAKYAKEERSAWFEIHVLPNLTVNQRAAFISKLFDDPSQSSELLSEAKKLNDSQAPK | 721 |
| Z11741 | VDAKYAKEEAAAWHEIHLLPNLTVTQIAAFISKLFDDPSQSSELLSEAKKLNDSQAPK | 722 |
| Z11742 | VDAKYAKEEREAWAEIHKLPNLTATQMHAFISKLFDDPSQSSELLSEAKKLNDSQAPK | 723 |
| Z11743 | VDAKYAKEEQRAWSEIHSLPNLTVNQMAAFIMKLYDDPSQSSELLSEAKKLNDSQAPK | 724 |
| Z11744 | VDAKYAKEEAKAWWEIHVLPNLTIDQITAFIHKLYDDPSQSSELLSEAKKLNDSQAPK | 725 |
| Z11745 | VDAKYAKEEAQAWWEIHTLPNLTVDQMAAFISKLFDDPSQSSELLSEAKKLNDSQAPK | 726 |

FIG. 1W

| Designation | Sequence | SEQ ID NO |
|---|---|---|
| Z11746 | VDAKYAKEERRAWHEIHILPNLTTSQMAAFIQKLFDDPSQSSELLSEAKKLNDSQAPK | 727 |
| Z11747 | VDAKYAKEERSAWYEIHTLPNLTTNQRTAFISKLFDDPSQSSELLSEAKKLNDSQAPK | 728 |
| Z11748 | VDAKYAKEERRAWFEIHMLPNLTIDQMAAFISKLFDDPSQSSELLSEAKKLNDSQAPK | 729 |
| Z11749 | VDAKYAKEEAKAWYEIHALPNLTVDQMVAFITKLFDDPSQSSELLSEAKKLNDSQAPK | 730 |
| Z11750 | VDAKYAKEEHVAWLEIHLLPNLTAEQMAAFISKLYDDPSQSSELLSEAKKLNDSQAPK | 731 |
| Z11751 | VDAKYAKEERDAWFEIHALPNLTVQQMAAFISKLFDDPSQSSELLSEAKKLNDSQAPK | 732 |
| Z11752 | VDAKYAKEEARAWREIHLLPNLTVDQMAAFISKLFDDPSQSSELLSEAKKLNDSQAPK | 733 |
| Z11753 | VDAKYAKEEARAWWEIHMLPNLTINQMAAFISKLFDDPSQSSELLSEAKKLNDSQAPK | 734 |
| Z11754 | VDAKYAKEEAAAWLEIHKLPNLTVHQMAAFISKLFDDPSQSSELLSEAKKLNDSQAPK | 735 |
| Z11755 | VDAKYAKEERQAWFEIHVLPNLTTDQMAAFIHKLYDDPSQSSELLSEAKKLNDSQAPK | 736 |
| Z11756 | VDAKYAKEEQRAWTEIHLLPNLTVNQMAAFISKLFDDPSQSSELLSEAKKLNDSQAPK | 737 |
| Z11757 | VDAKYAKEEQQAWYEIHTLPNLTVQQMAAFIQKLFDDPSQSSELLSEAKKLNDSQAPK | 738 |
| Z11758 | VDAKYAKEEQHAWREIHILPNLTVTQIAAFISKLFDDPSQSSELLSEAKKLNDSQAPK | 739 |
| Z11759 | VDAKYAKEEQRAWYEIHLLPNLTVTQMAAFISKLFDDPSQSSELLSEAKKLNDSQAPK | 740 |
| Z11760 | VDAKYAKEERAAWFEIHSLPNLTVSQMAAFISKLFDDPSQSSELLSEAKKLNDSQAPK | 741 |
| Z11761 | VDAKYAKEERQAWYEIHILPNLTAEQMAAFISKLFDDPSQSSELLSEAKKLNDSQAPK | 742 |
| Z11762 | VDAKYAKEEAQAWWEIHVLPNLTVRQIVAFISKLFDDPSQSSELLSEAKKLNDSQAPK | 743 |
| Z11763 | VDAKYAKEERRAWFEIHTLPNLTVHQMTAFIQKLFDDPSQSSELLSEAKKLNDSQAPK | 744 |
| Z11764 | VDAKYAKEEQRAWHEIHLLPNLTTRQMAAFISKLFDDPSQSSELLSEAKKLNDSQAPK | 745 |
| Z11765 | VDAKYAKEERHAWHEIHILPNLTIEQMVAFISKLFDDPSQSSELLSEAKKLNDSQAPK | 746 |
| Z11766 | VDAKYAKEERQAWFEIHALPNLTVQQVEAFISKLFDDPSQSSELLSEAKKLNDSQAPK | 747 |
| Z11767 | VDAKYAKEEQRAWREIHLLPNLTVTQMAAFISKLFDDPSQSSELLSEAKKLNDSQAPK | 748 |
| Z11768 | VDAKYAKEERHAWWEIHSLPNLTISQMAAFISKLFDDPSQSSELLSEAKKLNDSQAPK | 749 |
| Z11769 | VDAKYAKEEARAMLEIHALPNLTVDQMAAFISKLFDDPSQSSELLSEAKKLNDSQAPK | 750 |
| Z11770 | VDAKYAKEEQRAWHEIHTLPNLTVRQMAAFIIKLFDDPSQSSELLSEAKKLNDSQAPK | 751 |
| Z11771 | VDAKYAKEERHAWFEIHKLPNLTVEQMAAFIWKLFDDPSQSSELLSEAKKLNDSQAPK | 752 |
| Z11772 | VDAKYAKEERDAWYEIHLLPNLTINQIAAFISKLFDDPSQSSELLSEAKKLNDSQAPK | 753 |
| Z11773 | VDAKYAKEERQAWHEIHILPNLTVTQMTAFISKLFDDPSQSSELLSEAKKLNDSQAPK | 754 |
| Z11774 | VDAKYAKEEQAWTEIHSLPNLTATQVAAFIQKLFDDPSQSSELLSEAKKLNDSQAPK | 755 |
| Z11775 | VDAKYAKEEREAWWEIHHLPNLTVHQRAAFISKLFDDPSQSSELLSEAKKLNDSQAPK | 756 |
| Z11776 | VDAKYAKEERRAAWYEIHTLPNLTVSQMTAFISKLFDDPSQSSELLSEAKKLNDSQAPK | 757 |
| Z11777 | VDAKYAKEEHQAWWEIHLLPNLTARQMEAFIQKLFDDPSQSSELLSEAKKLNDSQAPK | 758 |
| Z11778 | VDAKYAKEEAHAWTEIHLLPNLTVDQMVAFISKLFDDPSQSSELLSEAKKLNDSQAPK | 759 |

FIG. 1X

| Designation | Sequence | SEQ ID NO |
|---|---|---|
| Z11779 | VDAKYAKEERRAWHEIHLLPNLTIQQIAAFISKLFDDPSQSSELLSEAKKLNDSQAPK | 760 |
| Z11780 | VDAKYAKEEHDAWFEIHTLPNLTVEQMAAFIMKLFDDPSQSSELLSEAKKLNDSQAPK | 761 |
| Z11782 | VDAKYAKEEHRAWLEIHLLPNLTVRQMAAFISKLFDDPSQSSELLSEAKKLNDSQAPK | 762 |
| Z11783 | VDAKYAKEEAKAWWEIHLLPNLTVDQMAAFISKLFDDPSQSSELLSEAKKLNDSQAPK | 763 |
| Z11785 | VDAKYAKEERKAWHEIHVLPNLTTNQRVAFIMKLMDDPSQSSELLSEAKKLNDSQAPK | 764 |
| Z11786 | VDAKYAKEERRAWWEIHLLPNLTVEQAAAFISKLFDDPSQSSELLSEAKKLNDSQAPK | 765 |
| Z11787 | VDAKYAKEEAAAWYEIHTLPNLTIDQMAAFISKLFDDPSQSSELLSEAKKLNDSQAPK | 766 |
| Z11790 | VDAKYAKEERAAWFEIHKLPNLTVSQMAAFIQKLFDDPSQSSELLSEAKKLNDSQAPK | 767 |
| Z11792 | VDAKYAKEEAEAWTEIHKLPNLTVHQMTAFIIKLFDDPSQSSELLSEAKKLNDSQAPK | 768 |
| Z11793 | VDAKYAKEERHAWWEIHKLPNLTISQMAAFISKLFDDPSQSSELLSEAKKLNDSQAPK | 769 |
| Z11795 | VDAKYAKEERKAWYEIHLLPNLTTSQRVAFISKLFDDPSQSSELLSEAKKLNDSQAPK | 770 |
| Z11796 | VDAKYAKEEASAWWEIHVLPNLTVNQIAAFISKLFDDPSQSSELLSEAKKLNDSQAPK | 771 |
| Z11797 | VDAKYAKEERDAWYEIHLLPNLTTDQMAAFISKLFDDPSQSSELLSEAKKLNDSQAPK | 772 |
| Z11798 | VDAKYAKEEAEAWLEIHLLPNLTVQQMAAFISKLFDDPSQSSELLSEAKKLNDSQAPK | 773 |
| Z11799 | VDAKYAKEEAKAWHEIHVLPNLTVRQIAAFISKLFDDPSQSSELLSEAKKLNDSQAPK | 774 |
| Z11800 | VDAKYAKEEASAWFEIHTLPNLTVDQMSAFIIKLFDDPSQSSELLSEAKKLNDSQAPK | 775 |
| Z11801 | VDAKYAKEERKAWYEIHVLPNLTVEQIAAFISKLFDDPSQSSELLSEAKKLNDSQAPK | 776 |
| Z11804 | VDAKYAKEERAAWHEIHVLPNLTTEQRVAFIKLYDDPSQSSELLSEAKKLNDSQAPK | 777 |
| Z11806 | VDAKYAKEEAQAWYEIHVLPNLTVRQMVAFISKLFDDPSQSSELLSEAKKLNDSQAPK | 778 |
| Z11807 | VDAKYAKEEAQAWWEIHLLPNLTVRQIAAFISKLFDDPSQSSELLSEAKKLNDSQAPK | 779 |
| Z11808 | VDAKYAKEEAAAWTEIHALPNLTVHQMAAFISKLFDDPSQSSELLSEAKKLNDSQAPK | 780 |
| Z11809 | VDAKYAKEERTAWWEIHALPNLTIDDPSQSSELLSEAKKLNDSQAPK | 781 |
| Z11810 | VDAKYAKEEHKAWREIHLLPNLTTEQMTAFISKLFDDPSQSSELLSEAKKLNDSQAPK | 782 |
| Z11811 | VDAKYAKEEQRAWFEIHLLPNLTVNQMAAFITKLFDDPSQSSELLSEAKKLNDSQAPK | 783 |
| Z11812 | VDAKYAKEERHAWWEIHKLPNLTIRQMAAFISKLFDDPSQSSELLSEAKKLNDSQAPK | 784 |
| Z11813 | VDAKYAKEEARAWHEIHILPNLTVRQISAFISKLFDDPSQSSELLSEAKKLNDSQAPK | 785 |
| Z11816 | VDAKYAKEERQAWFEIHALPNLTVNQMAAFIKLYDDPSQSSELLSEAKKLNDSQAPK | 786 |
| Z11820 | VDAKYAKEEAQAWSEIHLLPNLTIDQRVAFISKLFDDPSQSSELLSEAKKLNDSQAPK | 787 |
| Z11821 | VDAKYAKEERHAWHEIHILPNLTIINQMAAFISKLFDDPSQSSELLSEAKKLNDSQAPK | 788 |
| Z11822 | VDAKYAKEEAKAWAEIHALPNLTVTQMSAFIQKLFDDPSQSSELLSEAKKLNDSQAPK | 789 |
| Z11825 | VDAKYAKEERQAWFEIHILPNLTATQMAAFISKLFDDPSQSSELLSEAKKLNDSQAPK | 790 |
| Z11826 | VDAKYAKEERRAWWEIHVLPNLTVRQMAAFISKLFDDPSQSSELLSEAKKLNDSQAPK | 791 |
| Z11827 | VDAKYAKEEAHAWFEIHIDQRSAFISKLFDDPSQSSELLSEAKKLNDSQAPK | 792 |

FIG. 1Y

| Designation | Sequence | SEQ ID NO |
|---|---|---|
| Z11828 | VDAKYAKEEARARAWWEIHLLPNLTIRQMTAFISKLFDDPSQSSELLSEAKKLNDSQAPK | 793 |
| Z11829 | VDAKYAKEEAEAWHEIHVLPNLTVSQMAAFISKLFDDPSQSSELLSEAKKLNDSQAPK | 794 |
| Z11830 | VDAKYAKEERQAWREIHLLPNLTTDQMSAFISKLFDDPSQSSELLSEAKKLNDSQAPK | 795 |
| Z11831 | VDAKYAKEEATAWREIHLLPNLTVDQMAAFISKLFDDPSQSSELLSEAKKLNDSQAPK | 796 |
| Z11832 | VDAKYAKEERQAWWEIHKLPNLTVTQMAAFISKLFDDPSQSSELLSEAKKLNDSQAPK | 797 |
| Z11834 | VDAKYAKEEARAWREIHLLPNLTISQMAAFISKLFDDPSQSSELLSEAKKLNDSQAPK | 798 |
| Z11837 | VDAKYAKEEAEAWHEIHVLPNLTVEQMAAFISKLFDDPSQSSELLSEAKKLNDSQAPK | 799 |
| Z11838 | VDAKYAKEEAAAWLEIHLLPNLTIDQMAAFISKLFDDPSQSSELLSEAKKLNDSQAPK | 800 |
| Z11839 | VDAKYAKEERDAWYEIHLLPNLTVQQMSAFISKLFDDPSQSSELLSEAKKLNDSQAPK | 801 |
| Z11840 | VDAKYAKEERAAWFEIHTLPNLTVHQMAAFISKLFDDPSQSSELLSEAKKLNDSQAPK | 802 |
| Z11841 | VDAKYAKEEQSAWHEIHTLPNLTVNQMAAFIIKLFDDPSQSSELLSEAKKLNDSQAPK | 803 |
| Z11842 | VDAKYAKEERSAWFEIHIPNLTVRQMAAFIQKLFDDPSQSSELLSEAKKLNDSQAPK | 804 |
| Z11843 | VDAKYAKEEAQAWHEIHVLPNLTVNQMAAFISKLFDDPSQSSELLSEAKKLNDSQAPK | 805 |
| Z11844 | VDAKYAKEEAHAWREIHLLPNLTIKLFDDPSQSSELLSEAKKLNDSQAPK | 806 |
| Z11845 | VDAKYAKEEARAWREIHLLPNLTVQQMAAFIQKLFDDPSQSSELLSEAKKLNDSQAPK | 807 |
| Z11846 | VDAKYAKEERQAWYEIHMLPNLTITQLEAFISKLFDDPSQSSELLSEAKKLNDSQAPK | 808 |
| Z11847 | VDAKYAKEEREAWYEIHVLPNLTHHQMEAFIQKLFDDPSQSSELLSEAKKLNDSQAPK | 809 |
| Z11848 | VDAKYAKEERRAWFEIHLLPNLTVTQISAFISKLFDDPSQSSELLSEAKKLNDSQAPK | 810 |
| Z11849 | VDAKYAKEEREAWFEIHALPNLTVDQMSAFIIKLYDDPSQSSELLSEAKKLNDSQAPK | 811 |
| Z11850 | VDAKYAKEEREAWWEIHLLPNLTVEQMAAFIHKLYDDPSQSSELLSEAKKLNDSQAPK | 812 |
| Z11851 | VDAKYAKEEREAWHEIHTLPNLTVHQRAAFISKLFDDPSQSSELLSEAKKLNDSQAPK | 813 |
| Z11852 | VDAKYAKEEAQAWHEIHTLPNLTVDQMAAFISKLFDDPSQSSELLSEAKKLNDSQAPK | 814 |
| Z11853 | VDAKYAKEEQHAWYEIHIPNLTVTQMAAFISKLFDDPSQSSELLSEAKKLNDSQAPK | 815 |
| Z11854 | VDAKYAKEEHHAWYEIHTLPNLTIQQMAAFISKLFDDPSQSSELLSEAKKLNDSQAPK | 816 |
| Z11855 | VDAKYAKEEAHAWYEIHLLPNLTVNQMAAFIQMAAFISKLFDDPSQSSELLSEAKKLNDSQAPK | 817 |
| Z11856 | VDAKYAKEEAAWREIHTLPNLTAEQMAAFISKLFDDPSQSSELLSEAKKLNDSQAPK | 818 |
| Z11857 | VDAKYAKEEASAWYEIHTLPNLTVEQMAAFISKLFDDPSQSSELLSEAKKLNDSQAPK | 819 |
| Z11858 | VDAKYAKEERKAWYEIHVLPNLTVDQMAAFIQKLFDDPSQSSELLSEAKKLNDSQAPK | 820 |
| Z11859 | VDAKYAKEEAHAWHEIHILPNLTVNQIAAFISKLFDDPSQSSELLSEAKKLNDSQAPK | 821 |
| Z11863 | VDAKYAKEERRAWAEIHKLPNLTISQIAAFISKLFDDPSQSSELLSEAKKLNDSQAPK | 822 |
| Z11864 | VDAKYAKEEAHAWLEIHALPNLTIEQISAFIIKLYDDPSQSSELLSEAKKLNDSQAPK | 823 |
| Z11867 | VDAKYAKEERTAWYEIHILPNLTIQQMAAFISKLFDDPSQSSELLSEAKKLNDSQAPK | 824 |
| Z11868 | VDAKYAKEERHAWYEIHVLPNLTVTQMAAFISKLFDDPSQSSELLSEAKKLNDSQAPK | 825 |

FIG. 1Z

| Designation | Sequence | SEQ ID NO |
|---|---|---|
| Z11869 | VDAKYAKEERRAWYEIHLLPNLTVEQIAAFISKLFDDPSQSSELLSEAKKLNDSQAPK | 826 |
| Z11870 | VDAKYAKEERDAWFEIHALPNLTVTQVAAFISKLFDDPSQSSELLSEAKKLNDSQAPK | 827 |
| Z11873 | VDAKYAKEEQEAWTEIHTLPNLTIDQMTAFIIKLFDDPSQSSELLSEAKKLNDSQAPK | 828 |
| Z11876 | VDAKYAKEEREAWWEIHALPNLTTNQIAAFISKLFDDPSQSSELLSEAKKLNDSQAPK | 829 |
| Z11877 | VDAKYAKEERAAWYEIHLLPNLTVNQMAAFISKLFDDPSQSSELLSEAKKLNDSQAPK | 830 |
| Z11878 | VDAKYAKEEAKAWYEIHILPNLTVTQIAAFISKLFDDPSQSSELLSEAKKLNDSQAPK | 831 |
| Z11879 | VDAKYAKEEREAWHEIHILPNLTVNQMAAFISKLFDDPSQSSELLSEAKKLNDSQAPK | 832 |
| Z11880 | VDAKYAKEERAAWREIHLLPNLTVSQMEAFISKLFDDPSQSSELLSEAKKLNDSQAPK | 833 |
| Z11884 | VDAKYAKEERTAWFEIHTLPNLTVQQMAAFIIKLFDDPSQSSELLSEAKKLNDSQAPK | 834 |
| Z11885 | VDAKYAKEEREAWHEIHILPNLTIEQMAAFIQKLFDDPSQSSELLSEAKKLNDSQAPK | 835 |
| Z11886 | VDAKYAKEERQAWYEIHILPNLTVRQISAFISKLFDDPSQSSELLSEAKKLNDSQAPK | 836 |
| Z11887 | VDAKYAKEEAQAWTEIHIPNLTVSQMAAFIQKLFDDPSQSSELLSEAKKLNDSQAPK | 837 |
| Z11888 | VDAKYAKEEHDAWYEIHTLPNLTVDQVSAFISKLFDDPSQSSELLSEAKKLNDSQAPK | 838 |
| Z11889 | VDAKYAKEEAEAWREIHLLPNLTINQIAAFISKLFDDPSQSSELLSEAKKLNDSQAPK | 839 |
| Z11891 | VDAKYAKEEQSAWTEIHTLPNLTVDQRVAFISKLFDDPSQSSELLSEAKKLNDSQAPK | 840 |
| Z11894 | VDAKYAKEERDAWHEIHILPNLTIEQRAAFISKLFDDPSQSSELLSEAKKLNDSQAPK | 841 |
| Z11898 | VDAKYAKEEARAWHEIHVLPNLTTDQRVAFISKLFDDPSQSSELLSEAKKLNDSQAPK | 842 |
| Z11899 | VDAKYAKEEADAWFEIHMLPNLTIDQMTAFIMKLFDDPSQSSELLSEAKKLNDSQAPK | 843 |
| Z11900 | VDAKYAKEEAEAWWEIHALPNLTVSQTAAFISKLFDDPSQSSELLSEAKKLNDSQAPK | 844 |
| Z11902 | VDAKYAKEEARAWHEIHLLPNLTISQMTAFIIKLFDDPSQSSELLSEAKKLNDSQAPK | 845 |
| Z11908 | VDAKYAKEERRAWYEIHTLPNLTVSQMAAFISKLFDDPSQSSELLSEAKKLNDSQAPK | 846 |
| Z11909 | VDAKYAKEEREAWYEIHLLPNLTVTRQMAAFIIKLFDDPSQSSELLSEAKKLNDSQAPK | 847 |
| Z11910 | VDAKYAKEEHDAWYEIHVLPNLTVNQIAAFISKLFDDPSQSSELLSEAKKLNDSQAPK | 848 |
| Z11911 | VDAKYAKEEAHAWAEIHSLPNLTVDQMVAFIQKLFDDPSQSSELLSEAKKLNDSQAPK | 849 |
| Z11913 | VDAKYAKEEREAWWEIHKLPNLTVTQMAAFIQKLFDDPSQSSELLSEAKKLNDSQAPK | 850 |
| Z11914 | VDAKYAKEERVAWYEIHLLPNLTIDQMAAFISKLFDDPSQSSELLSEAKKLNDSQAPK | 851 |
| Z11915 | VDAKYAKEEARAWHEIHILPNLTVSQITAFISKLFDDPSQSSELLSEAKKLNDSQAPK | 852 |
| Z11916 | VDAKYAKEEADAWREIHLLPNLTASQMAAFIIKLYDDPSQSSELLSEAKKLNDSQAPK | 853 |
| Z11917 | VDAKYAKEEREAWTEIHSLPNLTVDQMAAFIIKLYDDPSQSSELLSEAKKLNDSQAPK | 854 |
| Z11919 | VDAKYAKEEARAWHEIHLLPNLTIEQMAAFISKLFDDPSQSSELLSEAKKLNDSQAPK | 855 |
| Z11920 | VDAKYAKEERRAWYEIHILPNLTVSQMAAFISKLFDDPSQSSELLSEAKKLNDSQAPK | 856 |
| Z11921 | VDAKYAKEEARAWYEIHLLPNLTIDQMAAFISKLFDDPSQSSELLSEAKKLNDSQAPK | 857 |
| Z11924 | VDAKYAKEERQAWHEIHTLPNLTTDQMAAFISKLFDDPSQSSELLSEAKKLNDSQAPK | 858 |

FIG. 1AA

| Designation | Sequence | SEQ ID NO |
|---|---|---|
| Z11925 | VDAKYAKEEHDAWWEIHKLPNLTVNQTAAFISKLFDDPSQSSELLSEAKKLNDSQAPK | 859 |
| Z11926 | VDAKYAKEERTAWHEIHSLPNLTIDQMAAFIIKLFDDPSQSSELLSEAKKLNDSQAPK | 860 |
| Z11927 | VDAKYAKEERAAWWEIHLLPNLTTTQMAAFISKLFDDPSQSSELLSEAKKLNDSQAPK | 861 |
| Z11928 | VDAKYAKEERDAWREIHLLPNLTIDQMAAFISKLFDDPSQSSELLSEAKKLNDSQAPK | 862 |
| Z11930 | VDAKYAKEEQVAWHEIHLLPNLTIDQMTAFISKLFDDPSQSSELLSEAKKLNDSQAPK | 863 |
| Z11931 | VDAKYAKEEAQAWREIHLLPNLTVDQMAAFISKLFDDPSQSSELLSEAKKLNDSQAPK | 864 |
| Z11932 | VDAKYAKEEAKAWFEIHILPNLTVQQVAAFISKLFDDPSQSSELLSEAKKLNDSQAPK | 865 |
| Z11934 | VDAKYAKEEHAAWREITLLPNLTINQRAAFISKLFDDPSQSSELLSEAKKLNDSQAPK | 866 |
| Z11935 | VDAKYAKEEAEAWSEIHKLPNLTVTQMAAFISKLFDDPSQSSELLSEAKKLNDSQAPK | 867 |
| Z11936 | VDAKYAKEEQQAWYEIHLLPNLTVTQMSAFISKLFDDPSQSSELLSEAKKLNDSQAPK | 868 |
| Z11938 | VDAKYAKEEARAWYEIHLLPNLTIEQMAAFISKLFDDPSQSSELLSEAKKLNDSQAPK | 869 |
| Z11940 | VDAKYAKEEAEAWTEIHLLPNLTVEQRVAFISKLFDDPSQSSELLSEAKKLNDSQAPK | 870 |
| Z11941 | VDAKYAKEERQAWTEIHLLPNLTVEQMAAFIQKLFDDPSQSSELLSEAKKLNDSQAPK | 871 |
| Z14455 | VDAKYAKEEYYAWTEIHKLPNLTIDQMAAFITKLFDDPSQSSELLSEAKKLNDSQAPK | 872 |
| Z14456 | VDAKYAKEEQAAWMEIHLLPNLTIDQMAAFITKLFDDPSQSSELLSEAKKLNDSQAPK | 873 |
| Z14457 | VDAKYAKEEYAAWTEIHLLPNLTIDQMAAFITKLFDDPSQSSELLSEAKKLNDSQAPK | 874 |
| Z14458 | VDAKYAKEEKEAWYEIHLLPNLTISQMAAFITKLFDDPSQSSELLSEAKKLNDSQAPK | 875 |
| Z14459 | VDAKYAKEEREAWYEIHLLPNLTIVQMAAFITKLFDDPSQSSELLSEAKKLNDSQAPK | 876 |
| Z14460 | VDAKYAKEEAAWVEIHKLPNLTVDQMAAFITKLFDDPSQSSELLSEAKKLNDSQAPK | 877 |
| Z14461 | VDAKYAKEEYAWKEIHLLPNLTIEQMAAFITKLFDDPSQSSELLSEAKKLNDSQAPK | 878 |
| Z14462 | VDAKYAKEEKAAWTEIHLLPNLTIFQMAAFITKLFDDPSQSSELLSEAKKLNDSQAPK | 879 |
| Z14463 | VDAKYAKEEKEAWYEIHLLPNLTITTQMAAFITKLFDDPSQSSELLSEAKKLNDSQAPK | 880 |
| Z14464 | VDAKYAKEERKAWYEIHLLPNLTVTQMAAFITKLFDDPSQSSELLSEAKKLNDSQAPK | 881 |
| Z14465 | VDAKYAKEEAMAWREIHLLPNLTVNQIAAFITKLFDDPSQSSELLSEAKKLNDSQAPK | 882 |
| Z14466 | VDAKYAKEEKHAWNEIHKLPNLTIVEQMAAFITKLFDDPSQSSELLSEAKKLNDSQAPK | 883 |
| Z14467 | VDAKYAKEEYEAWTEIHLLPNLTIDQMAAFITKLFDDPSQSSELLSEAKKLNDSQAPK | 884 |
| Z14468 | VDAKYAKEEWNAWTEIHNLPNLTIDQMAAFITKLFDDPSQSSELLSEAKKLNDSQAPK | 885 |
| Z14469 | VDAKYAKEERAAWTEIHGLPNLTVEQMAAFITKLFDDPSQSSELLSEAKKLNDSQAPK | 886 |
| Z14470 | VDAKYAKEEADAWLEIHNLPNLTISQMAAFITKLFDDPSQSSELLSEAKKLNDSQAPK | 887 |
| Z14471 | VDAKYAKEEKAAWHEIHILPNLTVYQIAAFITKLFDDPSQSSELLSEAKKLNDSQAPK | 888 |
| Z14472 | VDAKYAKEEKAWWEIHILPNLTIEQMAAFITKLFDDPSQSSELLSEAKKLNDSQAPK | 889 |
| Z14473 | VDAKYAKEEKSAWMEIHLLPNLTIEQMAAFITKLFDDPSQSSELLSEAKKLNDSQAPK | 890 |
| Z14474 | VDAKYAKEEYAAWMEIHRLPNLTIEQIAAFITKLFDDPSQSSELLSEAKKLNDSQAPK | 891 |

FIG. 1BB

| Designation | Sequence | SEQ ID NO |
|---|---|---|
| Z14475 | VDAKYAKEEFRAWIEIHTLPNLTVDQMAAFITKLFDDPSQSSELLSEAKKLNDSQAPK | 892 |
| Z14476 | VDAKYAKEEKDAWNEIHKLPNLTIEQIAAFITKLFDDPSQSSELLSEAKKLNDSQAPK | 893 |
| Z14477 | VDAKYAKEEKHAWYEIHLLPNLTVEQMAAFITKLFDDPSQSSELLSEAKKLNDSQAPK | 894 |
| Z14478 | VDAKYAKEEYEAWLEIHLLPNLTVDQMAAFISKLFDDPSQSSELLSEAKKLNDSQAPK | 895 |
| Z14479 | VDAKYAKEEKNAWHEIHRLPNLTVNQMAAFITKLFDDPSQSSELLSEAKKLNDSQAPK | 896 |
| Z14480 | VDAKYAKEEKNAWTEIHNLPNLTISQMAAFITKLFDDPSQSSELLSEAKKLNDSQAPK | 897 |
| Z14481 | VDAKYAKEEAAAWYEIHALPNLTVEQMAAFITKLFDDPSQSSELLSEAKKLNDSQAPK | 898 |
| Z14482 | VDAKYAKEEWNAWMEIHLLPNLTVTQMAAFITKLFDDPSQSSELLSEAKKLNDSQAPK | 899 |
| Z14483 | VDAKYAKEEAKAWHEIHILPNLTVHQIAAFITKLFDDPSQSSELLSEAKKLNDSQAPK | 900 |
| Z14484 | VDAKYAKEERKAWHEIHILPNLTVHQIAAFITKLFDDPSQSSELLSEAKKLNDSQAPK | 901 |
| Z14485 | VDAKYAKEESKAWFEIHALPNLTVEQIAAFITKLFDDPSQSSELLSEAKKLNDSQAPK | 902 |
| Z14486 | VDAKYAKEEKRAWYEIHILPNLTISQIAAFISKLFDDPSQSSELLSEAKKLNDSQAPK | 903 |
| Z14487 | VDAKYAKEEKKAWTEIHVLPNLTISQIAAFISKLFDDPSQSSELLSEAKKLNDSQAPK | 904 |
| Z14488 | VDAKYAKEERDAWFEIHALPNLTIDQMAAFITKLFDDPSQSSELLSEAKKLNDSQAPK | 905 |
| Z14489 | VDAKYAKEEYEAWEIHRLPNLTIDQMAAFITKLFDDPSQSSELLSEAKKLNDSQAPK | 906 |
| Z14490 | VDAKYAKEERNAWFEIHLLPNLTINQMAAFISKLFDDPSQSSELLSEAKKLNDSQAPK | 907 |
| Z14491 | VDAKYAKEEHHAWNEIHILPNLTVDQIAAFITKLFDDPSQSSELLSEAKKLNDSQAPK | 908 |
| Z14492 | VDAKYAKEEHYAWKEIHLLPNLTIDQMAAFISKLFDDPSQSSELLSEAKKLNDSQAPK | 909 |
| Z14493 | VDAKYAKEESDAWYEIHLLPNLTIEQMAAFITKLFDDPSQSSELLSEAKKLNDSQAPK | 910 |
| Z14494 | VDAKYAKEEYEAWMEIHLLPNLTIGQMAAFITKLFDDPSQSSELLSEAKKLNDSQAPK | 911 |
| Z14495 | VDAKYAKEEKEAWYEIHLLPNLTVEQMAAFITKLFDDPSQSSELLSEAKKLNDSQAPK | 912 |
| Z14496 | VDAKYAKEERAAWKEIHILPNLTVEQIAAFITKLFDDPSQSSELLSEAKKLNDSQAPK | 913 |
| Z14497 | VDAKYAKEEKEAWYEIHLLPNLTVHQMAAFITKLFDDPSQSSELLSEAKKLNDSQAPK | 914 |
| Z14498 | VDAKYAKEEYDAWIEIHALPNLTVDQMAAFISKLFDDPSQSSELLSEAKKLNDSQAPK | 915 |
| Z14499 | VDAKYAKEERKAWTEIHLLPNLTIDQMAAFITKLFDDPSQSSELLSEAKKLNDSQAPK | 916 |
| Z14500 | VDAKYAKEEYHAWVEIHNLPNLTIDQIAAFITKLFDDPSQSSELLSEAKKLNDSQAPK | 917 |
| Z14501 | VDAKYAKEEREAWTEIHKLPNLTIDQMAAFITKLFDDPSQSSELLSEAKKLNDSQAPK | 918 |
| Z14502 | VDAKYAKEEQWAWYEIHLLPNLTVDQIAAFITKLFDDPSQSSELLSEAKKLNDSQAPK | 919 |
| Z14503 | VDAKYAKEEKQAWMEIHKLPNLTVHQVAAFISKLFDDPSQSSELLSEAKKLNDSQAPK | 920 |
| Z14504 | VDAKYAKEESDAWTEIHKLPNLTIDQMAAFITKLFDDPSQSSELLSEAKKLNDSQAPK | 921 |
| Z14505 | VDAKYAKEEAQAWWEIHSLPNLTVDQIAAFITKLFDDPSQSSELLSEAKKLNDSQAPK | 922 |
| Z14506 | VDAKYAKEEKMAWYEIHNLPNLTVNQMAAFITKLFDDPSQSSELLSEAKKLNDSQAPK | 923 |
| Z14507 | VDAKYAKEEWMAWMEIHNLPNLTVNQMAAFITKLFDDPSQSSELLSEAKKLNDSQAPK | 924 |

FIG. 1CC

| Designation | Sequence | SEQ ID NO |
|---|---|---|
| Z14508 | VDAKYAKEEARAWYEIHILPNLTVKQMAAFITKLFDDPSQSSELLSEAKKLNDSQAPK | 925 |
| Z14509 | VDAKYAKEEAKAWHEIHILPNLTVSQVAAFITKLFDDPSQSSELLSEAKKLNDSQAPK | 926 |
| Z14510 | VDAKYAKEERAAWHEIHILPNLTVDQMAAFISKLFDDPSQSSELLSEAKKLNDSQAPK | 927 |
| Z14511 | VDAKYAKEEWQAWTEIHLLPNLTLDQVAAFITKLFDDPSQSSELLSEAKKLNDSQAPK | 928 |
| Z14512 | VDAKYAKEEAFAWEEIHRLPNLTIEQMAAFISKLFDDPSQSSELLSEAKKLNDSQAPK | 929 |
| Z14513 | VDAKYAKEERKAWYEIHKLPNLTVDQMAAFITKLFDDPSQSSELLSEAKKLNDSQAPK | 930 |
| Z14514 | VDAKYAKEEKQAWYEIHLLPNLTVEQMAAFITKLFDDPSQSSELLSEAKKLNDSQAPK | 931 |
| Z14515 | VDAKYAKEEYDAWWEIHLLPNLTVDQMAAFITKLFDDPSQSSELLSEAKKLNDSQAPK | 932 |
| Z14516 | VDAKYAKEEHDAWNEIHLLPNLTIDQMAAFITKLFDDPSQSSELLSEAKKLNDSQAPK | 933 |
| Z14517 | VDAKYAKEEYTAWTEIHQLPNLTVQQMAAFITKLFDDPSQSSELLSEAKKLNDSQAPK | 934 |
| Z14518 | VDAKYAKEEARAWHEIHILPNLTVRQIAAFITKLFDDPSQSSELLSEAKKLNDSQAPK | 935 |
| Z14519 | VDAKYAKEERNAWFEIHQLPNLTVHQVAAFITKLFDDPSQSSELLSEAKKLNDSQAPK | 936 |
| Z14520 | VDAKYAKEEADAWYEIHLLPNLTVEQMAAFITKLFDDPSQSSELLSEAKKLNDSQAPK | 937 |
| Z14522 | VDAKYAKEEFEAWKEIHILPNLTVHQMAAFITKLFDDPSQSSELLSEAKKLNDSQAPK | 938 |
| Z14523 | VDAKYAKEEAYAWWEIHKLPNLTVHQMAAFITKLFDDPSQSSELLSEAKKLNDSQAPK | 939 |
| Z14526 | VDAKYAKEEKTAWHEIHNLPNLTIDQMAAFITKLFDDPSQSSELLSEAKKLNDSQAPK | 940 |
| Z14527 | VDAKYAKEEAKAWNEIHKLPNLTIDQIAAFISKLFDDPSQSSELLSEAKKLNDSQAPK | 941 |
| Z14528 | VDAKYAKEEKDAWIEIHNLPNLTVEQMAAFITKLFDDPSQSSELLSEAKKLNDSQAPK | 942 |
| Z14529 | VDAKYAKEEFFAWKEIHLLPNLTVEQIAAFITKLFDDPSQSSELLSEAKKLNDSQAPK | 943 |
| Z14530 | VDAKYAKEEQAAWLEIHLLPNLTVSQIAAFITKLFDDPSQSSELLSEAKKLNDSQAPK | 944 |
| Z14531 | VDAKYAKEEYFAWREIHVLPNLTVDQMAAFISKLFDDPSQSSELLSEAKKLNDSQAPK | 945 |
| Z14532 | VDAKYAKEEYYAWREIHLLPNLTITQMAAFITKLFDDPSQSSELLSEAKKLNDSQAPK | 946 |
| Z14533 | VDAKYAKEEKMAWTEIHLLPNLTISQMAAFITKLFDDPSQSSELLSEAKKLNDSQAPK | 947 |
| Z14534 | VDAKYAKEERNAWFEIHVLPNLTVKQMAAFITKLFDDPSQSSELLSEAKKLNDSQAPK | 948 |
| Z14535 | VDAKYAKEEKRAWTEIHILPNLTVEQMAAFISKLFDDPSQSSELLSEAKKLNDSQAPK | 949 |
| Z14536 | VDAKYAKEEAAAWKEIHLLPNLTIDQMAAFITKLFDDPSQSSELLSEAKKLNDSQAPK | 950 |
| Z14537 | VDAKYAKEEAWMEIHALPNLTVDQVAAFITKLFDDPSQSSELLSEAKKLNDSQAPK | 951 |
| Z14539 | VDAKYAKEEKEAWYEIHNLPNLTIIQMAAFITKLFDDPSQSSELLSEAKKLNDSQAPK | 952 |
| Z14540 | VDAKYAKEEYDAWFEIHILPNLTVHQIAAFITKLFDDPSQSSELLSEAKKLNDSQAPK | 953 |
| Z14541 | VDAKYAKEEYGAWNEIHKLPNLTIDQMAAFITKLFDDPSQSSELLSEAKKLNDSQAPK | 954 |
| Z14542 | VDAKYAKEEWQAWMEIHSLPNLTVDQMAAFITKLFDDPSQSSELLSEAKKLNDSQAPK | 955 |
| Z14543 | VDAKYAKEEWNAWFEIHLLPNLTVEQMAAFITKLFDDPSQSSELLSEAKKLNDSQAPK | 956 |
| Z14544 | VDAKYAKEEANAWKEIHLLPNLTVDQMAAFITKLFDDPSQSSELLSEAKKLNDSQAPK | 957 |

FIG. 1DD

| Designation | Sequence | SEQ ID NO |
|---|---|---|
| Z14545 | VDAKYAKEEYEAWTEIHLLPNLTVHQMAAFITKLFDDPSQSSELLSEAKKLNDSQAPK | 958 |
| Z14546 | VDAKYAKEERIAWWEIHSLPNLTVNQVAAFISKLFDDPSQSSELLSEAKKLNDSQAPK | 959 |
| Z14548 | VDAKYAKEEYNAWVEIHTLPNLTVNQMAAFITKLFDDPSQSSELLSEAKKLNDSQAPK | 960 |
| Z14549 | VDAKYAKEEAFAWSEIHILPNLTIDQIAAFITKLFDDPSQSSELLSEAKKLNDSQAPK | 961 |
| Z14552 | VDAKYAKEEAHAWHEIHILPNLTIDQMAAFITKLFDDPSQSSELLSEAKKLNDSQAPK | 962 |
| Z14553 | VDAKYAKEEAAAWNEIHRLPNLTVDQIAAFISKLFDDPSQSSELLSEAKKLNDSQAPK | 963 |
| Z14554 | VDAKYAKEEKAAWTEIHLLPNLTVDQMAAFITKLFDDPSQSSELLSEAKKLNDSQAPK | 964 |
| Z14555 | VDAKYAKEEKGAWNEIHLLPNLTIQQMAAFISKLFDDPSQSSELLSEAKKLNDSQAPK | 965 |
| Z14557 | VDAKYAKEEYAAWMEIHSLPNLTVDQMAAFITKLFDDPSQSSELLSEAKKLNDSQAPK | 966 |
| Z14558 | VDAKYAKEEAAAWKEIHILPNLTIEQIAAFISKLFDDPSQSSELLSEAKKLNDSQAPK | 967 |
| Z14560 | VDAKYAKEEKFAWNEIHILPNLTVHQIAAFITKLFDDPSQSSELLSEAKKLNDSQAPK | 968 |
| Z14561 | VDAKYAKEEYNAWLEIHILPNLTINQMAAFITKLFDDPSQSSELLSEAKKLNDSQAPK | 969 |
| Z14562 | VDAKYAKEEHTAWLEIHSLPNLTIEQVAAFITKLFDDPSQSSELLSEAKKLNDSQAPK | 970 |
| Z14563 | VDAKYAKEEKDAWMEIHILPNLTVDQMAAFITKLFDDPSQSSELLSEAKKLNDSQAPK | 971 |
| Z14564 | VDAKYAKEEATAWIEIHSLPNLTVDQMAAFITKLFDDPSQSSELLSEAKKLNDSQAPK | 972 |
| Z14565 | VDAKYAKEEKEAWWEIHILPNLTVDQMAAFITKLFDDPSQSSELLSEAKKLNDSQAPK | 973 |
| Z14566 | VDAKYAKEEQHAWIEIHKLPNLTVDQMAAFITKLFDDPSQSSELLSEAKKLNDSQAPK | 974 |
| Z14567 | VDAKYAKEEKHAWHEIHILPNLTIEQMAAFISKLFDDPSQSSELLSEAKKLNDSQAPK | 975 |
| Z14568 | VDAKYAKEEAKAWHEIHIHLPNLTIEQMAAFITKLFDDPSQSSELLSEAKKLNDSQAPK | 976 |
| Z14569 | VDAKYAKEEKKAWTEIHILPNLTVEQIAAFITKLFDDPSQSSELLSEAKKLNDSQAPK | 977 |
| Z14570 | VDAKYAKEERAAWYEIHVLPNLTVSQMAAFISKLFDDPSQSSELLSEAKKLNDSQAPK | 978 |
| Z14571 | VDAKYAKEERFAWAEIHKLPNLTIDQMAAFITKLFDDPSQSSELLSEAKKLNDSQAPK | 979 |
| Z14572 | VDAKYAKEEYAAWFEIHLLPNLTIDQMAAFISKLFDDPSQSSELLSEAKKLNDSQAPK | 980 |
| Z14573 | VDAKYAKEEYDAWFEIHLLPNLTIDQMAAFITKLFDDPSQSSELLSEAKKLNDSQAPK | 981 |
| Z14574 | VDAKYAKEEWEAWMEIHALPNLTVDQMAAFITKLFDDPSQSSELLSEAKKLNDSQAPK | 982 |
| Z14575 | VDAKYAKEEKDAWWEIHALPNLTIEQMAAFITKLFDDPSQSSELLSEAKKLNDSQAPK | 983 |
| Z14576 | VDAKYAKEERDAWFEIHSLPNLTVDQMAAFITKLFDDPSQSSELLSEAKKLNDSQAPK | 984 |
| Z14577 | VDAKYAKEEFYAWLEIHKLPNLTVSQMAAFITKLFDDPSQSSELLSEAKKLNDSQAPK | 985 |
| Z14578 | VDAKYAKEEYEAWYEIHILPNLTIEQMAAFISKLFDDPSQSSELLSEAKKLNDSQAPK | 986 |
| Z14579 | VDAKYAKEERDAWFEIHLLPNLTVNQMAAFITKLFDDPSQSSELLSEAKKLNDSQAPK | 987 |
| Z14580 | VDAKYAKEEYRAWTEIHILPNLTITQIAAFITKLFDDPSQSSELLSEAKKLNDSQAPK | 988 |
| Z14581 | VDAKYAKEEYEAWLEIHILLPNLTIEQMAAFITKLFDDPSQSSELLSEAKKLNDSQAPK | 989 |
| Z14582 | VDAKYAKEEYDAWLEIHILPNLTVEQIAAFISKLFDDPSQSSELLSEAKKLNDSQAPK | 990 |

FIG. 1EE

| Designation | Sequence | SEQ ID NO |
|---|---|---|
| Z14583 | VDAKYAKEERKAWYEIHSLPNLTVDQMAAFITKLFDDPSQSSELLSEAKKLNDSQAPK | 991 |
| Z14584 | VDAKYAKEEHTAWTEIHRLPNLTIEQMAAFITKLFDDPSQSSELLSEAKKLNDSQAPK | 992 |
| Z14585 | VDAKYAKEEYQAWTEIHLLPNLTVEQMAAFITKLFDDPSQSSELLSEAKKLNDSQAPK | 993 |
| Z14586 | VDAKYAKEERRMAWFEIHSLPNLTVDQMAAFITKLFDDPSQSSELLSEAKKLNDSQAPK | 994 |
| Z14587 | VDAKYAKEEYDAWYEIHILPNLTVEQIAAFITKLFDDPSQSSELLSEAKKLNDSQAPK | 995 |
| Z14588 | VDAKYAKEEKEAWMEIHLLPNLTIDQMAAFITKLFDDPSQSSELLSEAKKLNDSQAPK | 996 |
| Z14589 | VDAKYAKEEYDAWFEIHSLPNLTVNQMAAFITKLFDDPSQSSELLSEAKKLNDSQAPK | 997 |
| Z14590 | VDAKYAKEEAFAWREIHILPNLTIDQMAAFITKLFDDPSQSSELLSEAKKLNDSQAPK | 998 |
| Z14591 | VDAKYAKEERKAWMEIHLLPNLTIEQMAAFITKLFDDPSQSSELLSEAKKLNDSQAPK | 999 |
| Z14592 | VDAKYAKEEKAAWIEIHNLPNLTVDQMAAFITKLFDDPSQSSELLSEAKKLNDSQAPK | 1000 |
| Z14593 | VDAKYAKEERNAWIEIHNLPNLTIEQMAAFITKLFDDPSQSSELLSEAKKLNDSQAPK | 1001 |
| Z14594 | VDAKYAKEEKNAWTEIHLLPNLTVGQIAAFITKLFDDPSQSSELLSEAKKLNDSQAPK | 1002 |
| Z14595 | VDAKYAKEEAEAAWWEIHILPNLTIDQMAAFITKLFDDPSQSSELLSEAKKLNDSQAPK | 1003 |
| Z14597 | VDAKYAKEEKLAWWEIHKLPNLTVDQMAAFITHQMAAFITKLFDDPSQSSELLSEAKKLNDSQAPK | 1004 |
| Z14598 | VDAKYAKEEYEAWYEIHILPNLTIHQMAAFITKLFDDPSQSSELLSEAKKLNDSQAPK | 1005 |
| Z14599 | VDAKYAKEEARAWKEIHLLPNLTVGQIAAFITKLFDDPSQSSELLSEAKKLNDSQAPK | 1006 |
| Z14600 | VDAKYAKEEKQAWMEIHLLPNLTVDQMAAFITKLFDDPSQSSELLSEAKKLNDSQAPK | 1007 |
| Z14601 | VDAKYAKEEAAAWHEIHILPNLTVHQIAAFITKLFDDPSQSSELLSEAKKLNDSQAPK | 1008 |
| Z14602 | VDAKYAKEEKEAWFEIHILPNLTVSQMAAFITKLFDDPSQSSELLSEAKKLNDSQAPK | 1009 |
| Z14603 | VDAKYAKEEKEAWFEIHTLPNLTVDQMAAFISKLFDDPSQSSELLSEAKKLNDSQAPK | 1010 |
| Z14604 | VDAKYAKEEYLAWVEIHNLPNLTIDQMAAFITKLFDDPSQSSELLSEAKKLNDSQAPK | 1011 |
| Z14605 | VDAKYAKEERDANYEIHNLPNLTVGQMAAFITKLFDDPSQSSELLSEAKKLNDSQAPK | 1012 |
| Z14606 | VDAKYAKEESAAWFEIHLLPNLTINQMAAFITKLFDDPSQSSELLSEAKKLNDSQAPK | 1013 |
| Z14607 | VDAKYAKEEQYAWTEIHILPNLTVNQIAAFITKLFDDPSQSSELLSEAKKLNDSQAPK | 1014 |
| Z14608 | VDAKYAKEEKRAWMEIHLLPNLTVSQMAAFITKLFDDPSQSSELLSEAKKLNDSQAPK | 1015 |
| Z14610 | VDAKYAKEEKKAWFEIHLLPNLTIHQVAAFISKLFDDPSQSSELLSEAKKLNDSQAPK | 1016 |
| Z14611 | VDAKYAKEEKEAWYEIHSLPNLTVDQVAAFITKLFDDPSQSSELLSEAKKLNDSQAPK | 1017 |
| Z14612 | VDAKYAKEEKEWLAWNEIHLLPNLTISQIAAFISKLFDDPSQSSELLSEAKKLNDSQAPK | 1018 |
| Z14613 | VDAKYAKEEYNAWLEIHILPNLTVHQIAAFISKLFDDPSQSSELLSEAKKLNDSQAPK | 1019 |
| Z14615 | VDAKYAKEEHTAWMEIHRLPNLTIDQIAAFISKLFDDPSQSSELLSEAKKLNDSQAPK | 1020 |
| Z14616 | VDAKYAKEEKFAWTEIHLLPNLTVHVMAAFITKLFDDPSQSSELLSEAKKLNDSQAPK | 1021 |
| Z14617 | VDAKYAKEEKYAWTEIHILPNLTVNQMAAFITKLFDDPSQSSELLSEAKKLNDSQAPK | 1022 |
| Z14618 | VDAKYAKEEKFAWHEIHKLPNLTVDQIAAFITKLFDDPSQSSELLSEAKKLNDSQAPK | 1023 |

FIG. 1FF

| Designation | Sequence | SEQ ID NO |
|---|---|---|
| Z14619 | VDAKYAKEERKAWYEIHGLPNLTVEQMAAFITKLFDDPSQSSELLSEAKKLNDSQAPK | 1024 |
| Z14621 | VDAKYAKEEYQAWLEIHLLPNLTVDQIAAFITKLFDDPSQSSELLSEAKKLNDSQAPK | 1025 |
| Z14622 | VDAKYAKEEKHAWMEIHLLPNLTVEQMAAFITKLFDDPSQSSELLSEAKKLNDSQAPK | 1026 |
| Z14623 | VDAKYAKEEKQAWREIHLLPNLTVDQIAAFISKLFDDPSQSSELLSEAKKLNDSQAPK | 1027 |
| Z14624 | VDAKYAKEEAMAWTEIHLLPNLTVSQMAAFITKLFDDPSQSSELLSEAKKLNDSQAPK | 1028 |
| Z14625 | VDAKYAKEEKHAWREIHLLPNLTLNQMAAFITKLFDDPSQSSELLSEAKKLNDSQAPK | 1029 |
| Z14626 | VDAKYAKEERYAWNEIHALPNLTVEQVAAFITKLFDDPSQSSELLSEAKKLNDSQAPK | 1030 |
| Z14627 | VDAKYAKEEREAWWEIHKLPNLTVDQMAAFISKLFDDPSQSSELLSEAKKLNDSQAPK | 1031 |
| Z14628 | VDAKYAKEEHRAWTEIHLLPNLTVDQMAAFISKLFDDPSQSSELLSEAKKLNDSQAPK | 1032 |
| Z14629 | VDAKYAKEEAYAWAEIHKLPNLTVQMAAFITKLFDDPSQSSELLSEAKKLNDSQAPK | 1033 |
| Z14631 | VDAKYAKEEYFAWTEIHKLPNLTIDQIAAFITKLFDDPSQSSELLSEAKKLNDSQAPK | 1034 |
| Z14632 | VDAKYAKEEAHAWQEIHKLPNLTINQIAAFISKLFDDPSQSSELLSEAKKLNDSQAPK | 1035 |
| Z14633 | VDAKYAKEEKHAWTEIHLLPNLTIDQMAAFITKLFDDPSQSSELLSEAKKLNDSQAPK | 1036 |
| Z14635 | VDAKYAKEEYRAWYEIHILPNLTVKQMAAFITKLFDDPSQSSELLSEAKKLNDSQAPK | 1037 |
| Z14636 | VDAKYAKEEANAWIEIHKLPNLTVDQMAAFITKLFDDPSQSSELLSEAKKLNDSQAPK | 1038 |
| Z14637 | VDAKYAKEEKDAWTEIHKLPNLTIDQMAAFITKLFDDPSQSSELLSEAKKLNDSQAPK | 1039 |
| Z14638 | VDAKYAKEEREAWYEIHNLPNLTITIQMAAFITKLFDDPSQSSELLSEAKKLNDSQAPK | 1040 |
| Z14639 | VDAKYAKEEYYAWNEIHLLPNLTIEQMAAFITKLFDDPSQSSELLSEAKKLNDSQAPK | 1041 |
| Z14640 | VDAKYAKEEKTAWREIHLLPNLTIDQIAAFITKLFDDPSQSSELLSEAKKLNDSQAPK | 1042 |
| Z14641 | VDAKYAKEEAHAWREIHIILPNLTIDQMAAFITKLFDDPSQSSELLSEAKKLNDSQAPK | 1043 |
| Z14642 | VDAKYAKEEAAAWLEIHQLPNLTVDQMAAFITKLFDDPSQSSELLSEAKKLNDSQAPK | 1044 |
| Z14643 | VDAKYAKEEAEAWLEIHILPNLTIDQMAAFITKLFDDPSQSSELLSEAKKLNDSQAPK | 1045 |
| Z14644 | VDAKYAKEEANAWFEIHILPNLTVEQMAAFITKLFDDPSQSSELLSEAKKLNDSQAPK | 1046 |
| Z14646 | VDAKYAKEERYAWMEIHLLPNLTVQQMAAFITKLFDDPSQSSELLSEAKKLNDSQAPK | 1047 |
| Z14647 | VDAKYAKEERFAWNEIHKLPNLTIDQMAAFITKLFDDPSQSSELLSEAKKLNDSQAPK | 1048 |
| Z14648 | VDAKYAKEEAKAWFEIHLLPNLTIDQIAAFITKLFDDPSQSSELLSEAKKLNDSQAPK | 1049 |
| Z14649 | VDAKYAKEEREAWTEIHILPNLTIQQIAAFITKLFDDPSQSSELLSEAKKLNDSQAPK | 1050 |
| Z14650 | VDAKYAKEEFEAWNEIHKLPNLTIEQMAAFITKLFDDPSQSSELLSEAKKLNDSQAPK | 1051 |
| Z14652 | VDAKYAKEEKEAWYEIHILPNLTVHQIAAFISKLFDDPSQSSELLSEAKKLNDSQAPK | 1052 |
| Z14653 | VDAKYAKEEYQAWVEIHNLPNLTVDQMAAFISKLFDDPSQSSELLSEAKKLNDSQAPK | 1053 |
| Z14654 | VDAKYAKEEKKAWREIHILPNLTINQIAAFITKLFDDPSQSSELLSEAKKLNDSQAPK | 1054 |
| Z14655 | VDAKYAKEEQDAWIEIHLLPNLTIDQMAAFISKLFDDPSQSSELLSEAKKLNDSQAPK | 1055 |
| Z14656 | VDAKYAKEEHDAWWEIHALPNLTINQMAAFISKLFDDPSQSSELLSEAKKLNDSQAPK | 1056 |

FIG. 1GG

| Designation | Sequence | SEQ ID NO |
|---|---|---|
| Z14657 | VDAKYAKEEYDAWYEIHLLPNLTIQQMAAFISKLFDDPSQSSELLSEAKKLNDSQAPK | 1057 |
| Z14658 | VDAKYAKEEYQAWVEIHILPNLTIQQIAAFITKLFDDPSQSSELLSEAKKLNDSQAPK | 1058 |
| Z14659 | VDAKYAKEESKAWNEIHKLPNLTITQMAAFITKLFDDPSQSSELLSEAKKLNDSQAPK | 1059 |
| Z14660 | VDAKYAKEEYQAWYEIHLLPNLTVEQMAAFITKLFDDPSQSSELLSEAKKLNDSQAPK | 1060 |
| Z14661 | VDAKYAKEEKRAWMEIHLLPNLTVGQMAAFITKLFDDPSQSSELLSEAKKLNDSQAPK | 1061 |
| Z14663 | VDAKYAKEERVAWLEIHILPNLTIGQIAAFITKLFDDPSQSSELLSEAKKLNDSQAPK | 1062 |
| Z14664 | VDAKYAKEEQAAWYEIHLLPNLTIEQMAAFITKLFDDPSQSSELLSEAKKLNDSQAPK | 1063 |
| Z14665 | VDAKYAKEEKDAWYEIHILPNLTVSQIAAFITKLFDDPSQSSELLSEAKKLNDSQAPK | 1064 |
| Z14666 | VDAKYAKEEKKAWYEIHLLPNLTISQMAAFITKLFDDPSQSSELLSEAKKLNDSQAPK | 1065 |
| Z14667 | VDAKYAKEEKKAWYEIHLLPNLTINQMAAFITKLFDDPSQSSELLSEAKKLNDSQAPK | 1066 |
| Z14668 | VDAKYAKEEHKAWTEIHLLPNLTVDQIAAFITKLFDDPSQSSELLSEAKKLNDSQAPK | 1067 |
| Z14669 | VDAKYAKEEAAAWHEIHLLPNLTIDQMAAFITKLFDDPSQSSELLSEAKKLNDSQAPK | 1068 |
| Z14670 | VDAKYAKEERSAWTEIHLLPNLTITQIAAFITKLFDDPSQSSELLSEAKKLNDSQAPK | 1069 |
| Z14671 | VDAKYAKEERLAWQEIHRLPNLTVDQMAAFITKLFDDPSQSSELLSEAKKLNDSQAPK | 1070 |
| Z14672 | VDAKYAKEEKDAWTEIHLLPNLTVEQMAAFISKLFDDPSQSSELLSEAKKLNDSQAPK | 1071 |
| Z14674 | VDAKYAKEEKAAWMEIHNLPNLTIDQMAAFITKLFDDPSQSSELLSEAKKLNDSQAPK | 1072 |
| Z14675 | VDAKYAKEEYEAWVEIHLLPNLTIDQMAAFITKLFDDPSQSSELLSEAKKLNDSQAPK | 1073 |
| Z14676 | VDAKYAKEEAKAWTEIHLLPNLTVNQIAAFITKLFDDPSQSSELLSEAKKLNDSQAPK | 1074 |
| Z14677 | VDAKYAKEEKKAWYEIHITLPNLTHQIAAFITKLFDDPSQSSELLSEAKKLNDSQAPK | 1075 |
| Z14678 | VDAKYAKEEKKAWFEIHLLPNLTVDQMAAFISKLFDDPSQSSELLSEAKKLNDSQAPK | 1076 |
| Z14679 | VDAKYAKEERKAWFEIHSLPNLTIDQMAAFITKLFDDPSQSSELLSEAKKLNDSQAPK | 1077 |
| Z14680 | VDAKYAKEERNAWYEIHLLPNLTVDQMAAFITKLFDDPSQSSELLSEAKKLNDSQAPK | 1078 |
| Z14681 | VDAKYAKEEASAWKEIHLLPNLTIDQVAAFITKLFDDPSQSSELLSEAKKLNDSQAPK | 1079 |
| Z14682 | VDAKYAKEEAAAWKEIHILPNLTIDQMAAFITKLFDDPSQSSELLSEAKKLNDSQAPK | 1080 |
| Z14683 | VDAKYAKEEAWAWHEIHILPNLTIEQMAAFITKLFDDPSQSSELLSEAKKLNDSQAPK | 1081 |
| Z14684 | VDAKYAKEEKYAWLEIHLLPNLTVDQVAAFITKLFDDPSQSSELLSEAKKLNDSQAPK | 1082 |
| Z14685 | VDAKYAKEERSAWMEIHLLPNLTINQMAAFISKLFDDPSQSSELLSEAKKLNDSQAPK | 1083 |
| Z14686 | VDAKYAKEERMAWNEIHGLPNLTVDQMAAFITKLFDDPSQSSELLSEAKKLNDSQAPK | 1084 |
| Z14687 | VDAKYAKEEAKAWYEIHILPNLTIIQMAAFITKLFDDPSQSSELLSEAKKLNDSQAPK | 1085 |
| Z14688 | VDAKYAKEEKWAWTEIHKLPNLTISQMAAFITKLFDDPSQSSELLSEAKKLNDSQAPK | 1086 |
| Z14689 | VDAKYAKEERMAWTEIHNLPNLTVEQVAAFITKLFDDPSQSSELLSEAKKLNDSQAPK | 1087 |
| Z14690 | VDAKYAKEEWAWKEIHLLPNLTVEQVAAFITKLFDDPSQSSELLSEAKKLNDSQAPK | 1088 |
| Z14691 | VDAKYAKEEKFAWTEIHKLPNLTVDQMAAFITKLFDDPSQSSELLSEAKKLNDSQAPK | 1089 |

FIG. 1HH

| Designation | Sequence | SEQ ID NO |
|---|---|---|
| Z14692 | VDAKYAKEEHYAWQEIHKLPNLTIDQMAAFITKLFDDPSQSSELLSEAKKLNDSQAPK | 1090 |
| Z14693 | VDAKYAKEERKAWYEIHILPNLTITQIAAFITKLFDDPSQSSELLSEAKKLNDSQAPK | 1091 |
| Z14694 | VDAKYAKEERYAWTEIHKLPNLTVDQVAAFISKLFDDPSQSSELLSEAKKLNDSQAPK | 1092 |
| Z14695 | VDAKYAKEEKEAWYEIHILPNLTVSQIAAFITKLFDDPSQSSELLSEAKKLNDSQAPK | 1093 |
| Z14696 | VDAKYAKEEYSAWFEIHILPNLTVEQMAAFISKLFDDPSQSSELLSEAKKLNDSQAPK | 1094 |
| Z14697 | VDAKYAKEERMAWNEIHKLPNLTIDQMAAFISKLFDDPSQSSELLSEAKKLNDSQAPK | 1095 |
| Z14698 | VDAKYAKEEAKAWTEIHLLPNLTVNQVAAFITKLFDDPSQSSELLSEAKKLNDSQAPK | 1096 |
| Z14699 | VDAKYAKEEKFAWREIHLLPNLTIEQMAAFISKLFDDPSQSSELLSEAKKLNDSQAPK | 1097 |
| Z14701 | VDAKYAKEEANAWHEIHLLPNLTIDQMAAFITKLFDDPSQSSELLSEAKKLNDSQAPK | 1098 |
| Z14702 | VDAKYAKEEKHAWNEIHRLPNLTVEQMAAFITKLFDDPSQSSELLSEAKKLNDSQAPK | 1099 |
| Z14703 | VDAKYAKEEHMAWTEIHALPNLTVDQMAAFISKLFDDPSQSSELLSEAKKLNDSQAPK | 1100 |
| Z14704 | VDAKYAKEEAWMEIHNLPNLTIEQMAAFITKLFDDPSQSSELLSEAKKLNDSQAPK | 1101 |
| Z14705 | VDAKYAKEERAAWYEIHILPNLTVEQMAAFITKLFDDPSQSSELLSEAKKLNDSQAPK | 1102 |
| Z14707 | VDAKYAKEEKNAWYEIHLLPNLTVVQMAAFITKLFDDPSQSSELLSEAKKLNDSQAPK | 1103 |
| Z14708 | VDAKYAKEEQIAWYEIHILPNLTVDQVAAFISKLFDDPSQSSELLSEAKKLNDSQAPK | 1104 |
| Z14709 | VDAKYAKEEYYAWTEIHRLPNLTVDQMAAFITKLFDDPSQSSELLSEAKKLNDSQAPK | 1105 |
| Z14711 | VDAKYAKEEADAWFEIHILPNLTVDQIAAFITKLFDDPSQSSELLSEAKKLNDSQAPK | 1106 |
| Z14713 | VDAKYAKEEAWMEIHKLPNLTVDQMAAFITKLFDDPSQSSELLSEAKKLNDSQAPK | 1107 |
| Z14714 | VDAKYAKEEYLAWIEIHALPNLTVSQMAAFITKLFDDPSQSSELLSEAKKLNDSQAPK | 1108 |
| Z14715 | VDAKYAKEEAFAWWEIHILPNLTINQMAAFITKLFDDPSQSSELLSEAKKLNDSQAPK | 1109 |
| Z14716 | VDAKYAKEEYNAWFEIHILPNLTISQMAAFITKLFDDPSQSSELLSEAKKLNDSQAPK | 1110 |
| Z14717 | VDAKYAKEEKEAWREIHILPNLTVDQMAAFISKLFDDPSQSSELLSEAKKLNDSQAPK | 1111 |
| Z14718 | VDAKYAKEEKKAWHEIHILPNLTITQIAAFISKLFDDPSQSSELLSEAKKLNDSQAPK | 1112 |
| Z14719 | VDAKYAKEEYHAWTEIHILPNLTINQMAAFISKLFDDPSQSSELLSEAKKLNDSQAPK | 1113 |
| Z14721 | VDAKYAKEEFSAWYEIHLLPNLTVDQMAAFITKLFDDPSQSSELLSEAKKLNDSQAPK | 1114 |
| Z14723 | VDAKYAKEERAAWWEIHILPNLTVSQMAAFISKLFDDPSQSSELLSEAKKLNDSQAPK | 1115 |
| Z14724 | VDAKYAKEEYEAWVEIHLLPNLTIDQMAAFITKLFDDPSQSSELLSEAKKLNDSQAPK | 1116 |
| Z14725 | VDAKYAKEEAEAWVEIHLLPNLTVNQMAAFITKLFDDPSQSSELLSEAKKLNDSQAPK | 1117 |
| Z14726 | VDAKYAKEEAKAWHEIHILPNLTITQIAAFISKLFDDPSQSSELLSEAKKLNDSQAPK | 1118 |
| Z14727 | VDAKYAKEEFYAWNEIHILPNLTVNQMAAFITKLFDDPSQSSELLSEAKKLNDSQAPK | 1119 |
| Z14728 | VDAKYAKEEYLAWTEIHLLPNLTIEQMAAFITKLFDDPSQSSELLSEAKKLNDSQAPK | 1120 |
| Z14729 | VDAKYAKEEHAAWREIHALPNLTVDQMAAFISKLFDDPSQSSELLSEAKKLNDSQAPK | 1121 |
| Z14730 | VDAKYAKEEQRAWMEIHLLPNLTIEQIAAFISKLFDDPSQSSELLSEAKKLNDSQAPK | 1122 |

FIG. 1II

| Designation | Sequence | SEQ ID NO |
|---|---|---|
| Z14732 | VDAKYAKEERDAWTEIHKLPNLTVDQMAAFITKLFDDPSQSSELLSEAKKLNDSQAPK | 1123 |
| Z14733 | VDAKYAKEERDAWFEIHRLPNLTVDQMAAFITKLFDDPSQSSELLSEAKKLNDSQAPK | 1124 |
| Z14734 | VDAKYAKEESYAWTEIHKLPNLTIDQMAAFITKLFDDPSQSSELLSEAKKLNDSQAPK | 1125 |
| Z14735 | VDAKYAKEEKFAWKEIHILPNLTIDQIAAFITKLFDDPSQSSELLSEAKKLNDSQAPK | 1126 |
| Z14736 | VDAKYAKEEHRAWMEIHQLPNLTVDQMAAFITKLFDDPSQSSELLSEAKKLNDSQAPK | 1127 |
| Z14737 | VDAKYAKEERTAWFEIHKLPNLTVDQMAAFITKLFDDPSQSSELLSEAKKLNDSQAPK | 1128 |
| Z14738 | VDAKYAKEERYAWWEIHKLPNLTVEQVAAFITKLFDDPSQSSELLSEAKKLNDSQAPK | 1129 |
| Z14739 | VDAKYAKEEEAWNEIHRLPNLTVVQMAAFISKLFDDPSQSSELLSEAKKLNDSQAPK | 1130 |
| Z14740 | VDAKYAKEEYEAWVEIHILPNLTVEQMAAFITKLFDDPSQSSELLSEAKKLNDSQAPK | 1131 |
| Z14741 | VDAKYAKEEYHAWTEIHLLPNLTIEQMAAFITKLFDDPSQSSELLSEAKKLNDSQAPK | 1132 |
| Z14742 | VDAKYAKEEYNAWYEIHVLPNLTIDQIAAFITKLFDDPSQSSELLSEAKKLNDSQAPK | 1133 |
| Z14743 | VDAKYAKEERKAWYEIHILPNLTVHQIAAFITKLFDDPSQSSELLSEAKKLNDSQAPK | 1134 |
| Z14744 | VDAKYAKEEWAAWIEIHSLPNLTVDQMAAFITKLFDDPSQSSELLSEAKKLNDSQAPK | 1135 |
| Z14745 | VDAKYAKEEAIAWSEIHSLPNLTVGQMAAFITKLFDDPSQSSELLSEAKKLNDSQAPK | 1136 |
| Z14747 | VDAKYAKEEKYAWTEIHILPNLTIDQMAAFITKLFDDPSQSSELLSEAKKLNDSQAPK | 1137 |
| Z14748 | VDAKYAKEEHTAWREIHLLPNLTISQMAAFITKLFDDPSQSSELLSEAKKLNDSQAPK | 1138 |
| Z14749 | VDAKYAKEEYTAWYEIHLLPNLTIEQMAAFITKLFDDPSQSSELLSEAKKLNDSQAPK | 1139 |
| Z14750 | VDAKYAKEEYEAWYEIHILPNLTIDQMAAFITKLFDDPSQSSELLSEAKKLNDSQAPK | 1140 |
| Z14751 | VDAKYAKEEKHAWTEIHLLPNLTISQMAAFITKLFDDPSQSSELLSEAKKLNDSQAPK | 1141 |
| Z14752 | VDAKYAKEEYTAWYEIHVLPNLTIRQMAAFITKLFDDPSQSSELLSEAKKLNDSQAPK | 1142 |
| Z14753 | VDAKYAKEEQRAWYEIHTLPNLTIDQMAAFITKLFDDPSQSSELLSEAKKLNDSQAPK | 1143 |
| Z14754 | VDAKYAKEEAVAWKEIHLLPNLTIDQIAAFISKLFDDPSQSSELLSEAKKLNDSQAPK | 1144 |
| Z14755 | VDAKYAKEEYRAWMEIHALPNLTIVQIAAFITKLFDDPSQSSELLSEAKKLNDSQAPK | 1145 |
| Z14756 | VDAKYAKEERSAWNEIHILPNLTIDQMAAFITKLFDDPSQSSELLSEAKKLNDSQAPK | 1146 |
| Z14757 | VDAKYAKEEAEAWFEIHILPNLTVGQIAAFITKLFDDPSQSSELLSEAKKLNDSQAPK | 1147 |
| Z14758 | VDAKYAKEEKMAWNEIHILPNLTVEQIAAFISKLFDDPSQSSELLSEAKKLNDSQAPK | 1148 |
| Z14759 | VDAKYAKEERTAWMEIHKLPNLTIDQMAAFISKLFDDPSQSSELLSEAKKLNDSQAPK | 1149 |
| Z14760 | VDAKYAKEEYEAWYEIHALPNLTLHQMAAFISKLFDDPSQSSELLSEAKKLNDSQAPK | 1150 |
| Z14761 | VDAKYAKEEYDAWFEIHVLPNLTVNQMAAFITKLFDDPSQSSELLSEAKKLNDSQAPK | 1151 |
| Z14762 | VDAKYAKEESLAWMEIHKLPNLTVDQVAAFITKLFDDPSQSSELLSEAKKLNDSQAPK | 1152 |
| Z14763 | VDAKYAKEERNAWWEIHALPNLTVNQMAAFITKLFDDPSQSSELLSEAKKLNDSQAPK | 1153 |
| Z14764 | VDAKYAKEEKKAWKEIHLLPNLTVNQMAAFISKLFDDPSQSSELLSEAKKLNDSQAPK | 1154 |
| Z14766 | VDAKYAKEEKYAWTEIHNLPNLTILQMAAFITKLFDDPSQSSELLSEAKKLNDSQAPK | 1155 |

FIG. 1JJ

| Designation | Sequence | SEQ ID NO |
|---|---|---|
| Z14768 | VDAKYAKEEYKAWVEIHLLPNLTVDQMAAFISKLFDDPSQSSELLSEAKKLNDSQAPK | 1156 |
| Z14769 | VDAKYAKEEHAAWLEIHLLPNLTVSQIAAFITKLFDDPSQSSELLSEAKKLNDSQAPK | 1157 |
| Z14770 | VDAKYAKEEYHAWWEIHALPNLTVEQMAAFITKLFDDPSQSSELLSEAKKLNDSQAPK | 1158 |
| Z14771 | VDAKYAKEERYAWNEIHRLPNLTVDQMAAFITKLFDDPSQSSELLSEAKKLNDSQAPK | 1159 |
| Z14772 | VDAKYAKEEAQAWMEIHLLPNLTIAQMAAFITKLFDDPSQSSELLSEAKKLNDSQAPK | 1160 |
| Z14773 | VDAKYAKEEREAWYEIHLLPNLTVNQMAAFITKLFDDPSQSSELLSEAKKLNDSQAPK | 1161 |
| Z14774 | VDAKYAKEEAYAWNEIHKLPNLTVEQMAAFISKLFDDPSQSSELLSEAKKLNDSQAPK | 1162 |
| Z14775 | VDAKYAKEEYDAWAEIHRLPNLTISQMAAFITKLFDDPSQSSELLSEAKKLNDSQAPK | 1163 |
| Z14776 | VDAKYAKEEYHAWTEIHILPNLTINQIAAFITKLFDDPSQSSELLSEAKKLNDSQAPK | 1164 |
| Z14777 | VDAKYAKEERQAWFEIHILPNLTVGQMAAFISKLFDDPSQSSELLSEAKKLNDSQAPK | 1165 |
| Z14778 | VDAKYAKEEAEAWFEIHILPNLTVDQIAAFITKLFDDPSQSSELLSEAKKLNDSQAPK | 1166 |
| Z14779 | VDAKYAKEEKKAWYEIHILPNLTVYQMAAFITKLFDDPSQSSELLSEAKKLNDSQAPK | 1167 |
| Z14780 | VDAKYAKEEKAAWNEIHILPNLTVHQMAAFITKLFDDPSQSSELLSEAKKLNDSQAPK | 1168 |
| Z14781 | VDAKYAKEEAQAWNEIHILPNLTVEQMAAFISKLFDDPSQSSELLSEAKKLNDSQAPK | 1169 |
| Z14785 | VDAKYAKEEYEAWYEIHILPNLTVHQIAAFITKLFDDPSQSSELLSEAKKLNDSQAPK | 1170 |
| Z14786 | VDAKYAKEEYEAWMEIHLLPNLTVHQMAAFITKLFDDPSQSSELLSEAKKLNDSQAPK | 1171 |
| Z14787 | VDAKYAKEEYDAWFEIHVLPNLTINQMAAFITKLFDDPSQSSELLSEAKKLNDSQAPK | 1172 |
| Z14789 | VDAKYAKEEKRAWNEIHQLPNLTIEQIAAFITKLFDDPSQSSELLSEAKKLNDSQAPK | 1173 |
| Z14790 | VDAKYAKEEARAWWEIHLLPNLTVDQIAAFITKLFDDPSQSSELLSEAKKLNDSQAPK | 1174 |
| Z14791 | VDAKYAKEEKHAWREIHLLPNLTVDQIAAFITKLFDDPSQSSELLSEAKKLNDSQAPK | 1175 |
| Z14792 | VDAKYAKEESRAWTEIHLLPNLTVDQMAAFITKLFDDPSQSSELLSEAKKLNDSQAPK | 1176 |
| Z14793 | VDAKYAKEEAEAWKEIHLLPNLTIGQIAAFITKLFDDPSQSSELLSEAKKLNDSQAPK | 1177 |
| Z14794 | VDAKYAKEEADAWKEIHLLPNLTIEQMAAFITKLFDDPSQSSELLSEAKKLNDSQAPK | 1178 |
| Z14795 | VDAKYAKEEYQAWMEIHILPNLTIEQMAAFITKLFDDPSQSSELLSEAKKLNDSQAPK | 1179 |
| Z14796 | VDAKYAKEEAHAWWEIHKLPNLTVNQMAAFITKLFDDPSQSSELLSEAKKLNDSQAPK | 1180 |
| Z14797 | VDAKYAKEEWYAWNEIHNLPNLTVDQMAAFITKLFDDPSQSSELLSEAKKLNDSQAPK | 1181 |
| Z14798 | VDAKYAKEEKKAWNEIHGLPNLTVDQVAAFISKLFDDPSQSSELLSEAKKLNDSQAPK | 1182 |
| Z14799 | VDAKYAKEEAAAWMEIHLLPNLTVEQMAAFITKLFDDPSQSSELLSEAKKLNDSQAPK | 1183 |
| Z14800 | VDAKYAKEEKFAWREIHILPNLTIEQMAAFITKLFDDPSQSSELLSEAKKLNDSQAPK | 1184 |
| Z14801 | VDAKYAKEEYHAWTEIHQLPNLTIDQMAAFISKLFDDPSQSSELLSEAKKLNDSQAPK | 1185 |
| Z14802 | VDAKYAKEEAMAWNEIHRLPNLTVNQMAAFISKLFDDPSQSSELLSEAKKLNDSQAPK | 1186 |
| Z14803 | VDAKYAKEEQKAWREIHILPNLTVNQMAAFISKLFDDPSQSSELLSEAKKLNDSQAPK | 1187 |
| Z14804 | VDAKYAKEEFAAWLEIHKLPNLTIDQMAAFITKLFDDPSQSSELLSEAKKLNDSQAPK | 1188 |

FIG. 1KK

| Designation | Sequence | SEQ ID NO |
|---|---|---|
| Z14805 | VDAKYAKEEAYAWAEIHKLPNLTVNQMAAFITKLFDDPSQSSELLSEAKKLNDSQAPK | 1189 |
| Z14806 | VDAKYAKEEKDAWYEIHILPNLTVRQMAAFISKLFDDPSQSSELLSEAKKLNDSQAPK | 1190 |
| Z14807 | VDAKYAKEEKDAWMEIHLLPNLTVSQIAAFITKLFDDPSQSSELLSEAKKLNDSQAPK | 1191 |
| Z14808 | VDAKYAKEEKEAWTEIHKLPNLTINQMAAFISKLFDDPSQSSELLSEAKKLNDSQAPK | 1192 |
| Z14809 | VDAKYAKEEKDAWREIHILPNLTIEQMAAFISKLFDDPSQSSELLSEAKKLNDSQAPK | 1193 |
| Z14810 | VDAKYAKEEYRAWTEIHLLPNLTIEHMAAFITKLFDDPSQSSELLSEAKKLNDSQAPK | 1194 |
| Z14811 | VDAKYAKEEKFAWHEIHILPNLTVHQMAAFITKLFDDPSQSSELLSEAKKLNDSQAPK | 1195 |
| Z14812 | VDAKYAKEEWEAWLEIHALPNLTVEQMAAFITKLFDDPSQSSELLSEAKKLNDSQAPK | 1196 |
| Z14813 | VDAKYAKEEAAAWQEIHLLPNLTVGQIAAFITKLFDDPSQSSELLSEAKKLNDSQAPK | 1197 |
| Z14814 | VDAKYAKEEKVAWKEIHILPNLTVNQIAAFISKLFDDPSQSSELLSEAKKLNDSQAPK | 1198 |
| Z14815 | VDAKYAKEERVAWQEIHLLPNLTIEQMAAFITKLFDDPSQSSELLSEAKKLNDSQAPK | 1199 |
| Z14816 | VDAKYAKEEYEAWLEIHLLPNLTIDQMAAFITKLFDDPSQSSELLSEAKKLNDSQAPK | 1200 |
| Z14817 | VDAKYAKEEAEAWFEIHNLPNLTIDQMAAFITKLFDDPSQSSELLSEAKKLNDSQAPK | 1201 |
| Z14818 | VDAKYAKEEKYAWWEIHKLPNLTVRQMAAFITKLFDDPSQSSELLSEAKKLNDSQAPK | 1202 |
| Z14819 | VDAKYAKEEYDAWHEIHVLPNLTVSQIAAFISKLFDDPSQSSELLSEAKKLNDSQAPK | 1203 |
| Z14820 | VDAKYAKEEAAAWREIHLLPNLTVDQMAAFITKLFDDPSQSSELLSEAKKLNDSQAPK | 1204 |
| Z14821 | VDAKYAKEEKHAWNEIHKLPNLTVKQVAAFITKLFDDPSQSSELLSEAKKLNDSQAPK | 1205 |
| Z14822 | VDAKYAKEEYDAWTEIHLLPNLTIAQIAAFITKLFDDPSQSSELLSEAKKLNDSQAPK | 1206 |
| Z14823 | VDAKYAKEERKAWHEIHILPNLTIDQMAAFITKLFDDPSQSSELLSEAKKLNDSQAPK | 1207 |
| Z14824 | VDAKYAKEEHDAWHEIHLLPNLTVDQIAAFITKLFDDPSQSSELLSEAKKLNDSQAPK | 1208 |
| Z14825 | VDAKYAKEEYAAWNEIHKLPNLTIIQMAAFITKLFDDPSQSSELLSEAKKLNDSQAPK | 1209 |
| Z14826 | VDAKYAKEEYEAWMEIHLLPNLTIEQMAAFITKLFDDPSQSSELLSEAKKLNDSQAPK | 1210 |
| Z14827 | VDAKYAKEEKHAWIEIHALPNLTIDQMAAFITKLFDDPSQSSELLSEAKKLNDSQAPK | 1211 |
| Z14828 | VDAKYAKEEKYAWHEIHILPNLTVDQVAAFISKLFDDPSQSSELLSEAKKLNDSQAPK | 1212 |
| Z14830 | VDAKYAKEEKDAWHEIHILPNLTVDQMAAFITKLFDDPSQSSELLSEAKKLNDSQAPK | 1213 |
| Z14831 | VDAKYAKEEYHAWMEIHILPNLTIEQIAAFITKLFDDPSQSSELLSEAKKLNDSQAPK | 1214 |
| Z14832 | VDAKYAKEEYRAWHEIHLLPNLTIIQMAAFITKLFDDPSQSSELLSEAKKLNDSQAPK | 1215 |
| Z14833 | VDAKYAKEEKFAWHEIHILPNLTVDQMAAFITKLFDDPSQSSELLSEAKKLNDSQAPK | 1216 |
| Z14834 | VDAKYAKEEKHAWTEIHILPNLTVNQMAAFITKLFDDPSQSSELLSEAKKLNDSQAPK | 1217 |
| Z14835 | VDAKYAKEEEFAWREIHILPNLTISQIAAFITKLFDDPSQSSELLSEAKKLNDSQAPK | 1218 |
| Z14836 | VDAKYAKEEKMAWKEIHVLPNLTVDQMAAFITKLFDDPSQSSELLSEAKKLNDSQAPK | 1219 |
| Z14837 | VDAKYAKEEYAAWHEIHVLPNLTIGQMAAFITKLFDDPSQSSELLSEAKKLNDSQAPK | 1220 |
| Z14838 | VDAKYAKEEQYAWQEIHKLPNLTVEQMAAFITKLFDDPSQSSELLSEAKKLNDSQAPK | 1221 |

FIG. 1LL

| Designation | Sequence | SEQ ID NO |
|---|---|---|
| Z14839 | VDAKYAKEEWEAWNEIHSLPNLTIDQIAAFITKLFDDPSQSSELLSEAKKLNDSQAPK | 1222 |
| Z14840 | VDAKYAKEEKMAWKEIHLLPNLTVEQMAAFITKLFDDPSQSSELLSEAKKLNDSQAPK | 1223 |
| Z14841 | VDAKYAKEEAHAWREIHNLPNLTIEQMAAFISKLFDDPSQSSELLSEAKKLNDSQAPK | 1224 |
| Z14842 | VDAKYAKEERRAWTEIHILPNLTVDQIAAFISKLFDDPSQSSELLSEAKKLNDSQAPK | 1225 |
| Z14843 | VDAKYAKEEYEAWMEIHLLPNLTINQIAAFITKLFDDPSQSSELLSEAKKLNDSQAPK | 1226 |
| Z14844 | VDAKYAKEEKHAWMEIHALPNLTIDQMAAFITKLFDDPSQSSELLSEAKKLNDSQAPK | 1227 |
| Z14845 | VDAKYAKEEHQAWHEIHILPNLTIQQMAAFITKLFDDPSQSSELLSEAKKLNDSQAPK | 1228 |
| Z14846 | VDAKYAKEEYYAWREIHLLPNLTVDQMAAFITKLFDDPSQSSELLSEAKKLNDSQAPK | 1229 |
| Z14847 | VDAKYAKEEQEAWMEIHKLPNLTIDQVAAFITKLFDDPSQSSELLSEAKKLNDSQAPK | 1230 |
| Z14848 | VDAKYAKEEAHAWTEIHSLPNLTVDQMAAFITKLFDDPSQSSELLSEAKKLNDSQAPK | 1231 |
| Z14849 | VDAKYAKEEKLAWKEIHLLPNLTISQMAAFITKLFDDPSQSSELLSEAKKLNDSQAPK | 1232 |
| Z14850 | VDAKYAKEEYDAWTEIHKLPNLTVDQMAAFISKLFDDPSQSSELLSEAKKLNDSQAPK | 1233 |
| Z14851 | VDAKYAKEEARAWMEIHNLPNLTVDQMAAFITKLFDDPSQSSELLSEAKKLNDSQAPK | 1234 |
| Z14852 | VDAKYAKEEYRAWTEIHLLPNLTVHQMAAFITKLFDDPSQSSELLSEAKKLNDSQAPK | 1235 |
| Z14853 | VDAKYAKEEYHAWYEIHILPNLTVEQIAAFITKLFDDPSQSSELLSEAKKLNDSQAPK | 1236 |
| Z14854 | VDAKYAKEESDAWKEIHLLPNLTIEQMAAFISKLFDDPSQSSELLSEAKKLNDSQAPK | 1237 |
| Z14855 | VDAKYAKEEAYAWREIHILPNLTVDQMAAFISKLFDDPSQSSELLSEAKKLNDSQAPK | 1238 |
| Z14856 | VDAKYAKEEAAAWNEIHRLPNLTIDQMAAFITKLFDDPSQSSELLSEAKKLNDSQAPK | 1239 |
| Z14858 | VDAKYAKEEYHAWWEIHKLPNLTVNQMAAFITKLFDDPSQSSELLSEAKKLNDSQAPK | 1240 |
| Z14859 | VDAKYAKEEKAAWYEIHKLPNLTIDQMAAFITKLFDDPSQSSELLSEAKKLNDSQAPK | 1241 |
| Z14860 | VDAKYAKEEKEAWTEIHLLPNLTVDQIAAFITKLFDDPSQSSELLSEAKKLNDSQAPK | 1242 |
| Z14863 | VDAKYAKEEKRAWYEIHGLPNLTISQMAAFISKLFDDPSQSSELLSEAKKLNDSQAPK | 1243 |
| Z14864 | VDAKYAKEEARAWYEIHILPNLTVHQMAAFITKLFDDPSQSSELLSEAKKLNDSQAPK | 1244 |
| Z14865 | VDAKYAKEEKTAWVEIHKLPNLTINQMAAFITKLFDDPSQSSELLSEAKKLNDSQAPK | 1245 |
| Z14866 | VDAKYAKEERDAWFEIHILPNLTIEQMAAFISKLFDDPSQSSELLSEAKKLNDSQAPK | 1246 |
| Z14869 | VDAKYAKEEAMAWKEIHGLPNLTIEQMAAFITKLFDDPSQSSELLSEAKKLNDSQAPK | 1247 |
| Z14870 | VDAKYAKEEQYAWREIHILPNLTVHQVAAFITKLFDDPSQSSELLSEAKKLNDSQAPK | 1248 |
| Z14871 | VDAKYAKEEWEAWIEIHNLPNLTVEQMAAFITKLFDDPSQSSELLSEAKKLNDSQAPK | 1249 |
| Z14872 | VDAKYAKEEYAAWTEIHTLPNLTVDQVAAFITKLFDDPSQSSELLSEAKKLNDSQAPK | 1250 |
| Z14873 | VDAKYAKEEDAWHEIHLLPNLTIEQMAAFITKLFDDPSQSSELLSEAKKLNDSQAPK | 1251 |
| Z14874 | VDAKYAKEERNAWYEIHALPNLTVEQMAAFITKLFDDPSQSSELLSEAKKLNDSQAPK | 1252 |
| Z14875 | VDAKYAKEEKRAWYEIHILPNLTVEQIAAFITKLFDDPSQSSELLSEAKKLNDSQAPK | 1253 |
| Z14876 | VDAKYAKEEYQAWIEIHILPNLTISQMAAFITKLFDDPSQSSELLSEAKKLNDSQAPK | 1254 |

FIG. 1MM

| Designation | Sequence | SEQ ID NO |
|---|---|---|
| Z14877 | VDAKYAKEEKRAWYEIHLLPNLTIGQMAAFITKLFDDPSQSSELLSEAKKLNDSQAPK | 1255 |
| Z14879 | VDAKYAKEEYLAWLEIHNLPNLTVDQMAAFITKLFDDPSQSSELLSEAKKLNDSQAPK | 1256 |
| Z14880 | VDAKYAKEEYFAWYEIHNLPNLTVDQMAAFITKLFDDPSQSSELLSEAKKLNDSQAPK | 1257 |
| Z14881 | VDAKYAKEEAFAWWEIHKLPNLTVEQMAAFITKLFDDPSQSSELLSEAKKLNDSQAPK | 1258 |
| Z14882 | VDAKYAKEESIAWQEIHLLPNLTIEQMAAFITKLFDDPSQSSELLSEAKKLNDSQAPK | 1259 |
| Z14883 | VDAKYAKEEWDAWNEIHLLPNLTINQMAAFITKLFDDPSQSSELLSEAKKLNDSQAPK | 1260 |
| Z14884 | VDAKYAKEEAYAWNEIHRLPNLTVEQMAAFITKLFDDPSQSSELLSEAKKLNDSQAPK | 1261 |
| Z14885 | VDAKYAKEEAEAWFEIHKLPNLTVGQMAAFITKLFDDPSQSSELLSEAKKLNDSQAPK | 1262 |
| Z14886 | VDAKYAKEEREAWHEIHILPNLTVEQVAAFITKLFDDPSQSSELLSEAKKLNDSQAPK | 1263 |
| Z14887 | VDAKYAKEEHDAWMEIHLLPNLTIEQMAAFITKLFDDPSQSSELLSEAKKLNDSQAPK | 1264 |
| Z14889 | VDAKYAKEEYSAWIEIHLLPNLTVSQMAAFITKLFDDPSQSSELLSEAKKLNDSQAPK | 1265 |
| Z14890 | VDAKYAKEEYDAWYEIHTLPNLTVDQVAAFITKLFDDPSQSSELLSEAKKLNDSQAPK | 1266 |
| Z14891 | VDAKYAKEEKMAWTEIHNLPNLTIDQMAAFITKLFDDPSQSSELLSEAKKLNDSQAPK | 1267 |
| Z14892 | VDAKYAKEEYAAWFEIHSLPNLTVEQMAAFITKLFDDPSQSSELLSEAKKLNDSQAPK | 1268 |
| Z14893 | VDAKYAKEERRAWDEIHRLPNLTIEQMAAFITKLFDDPSQSSELLSEAKKLNDSQAPK | 1269 |
| Z14894 | VDAKYAKEEYDAWLEIHLLPNLTIEQMAAFITKLFDDPSQSSELLSEAKKLNDSQAPK | 1270 |
| Z14895 | VDAKYAKEEYDAWNEIHTLPNLTIHALPNLTVDQVAAFISKLFDDPSQSSELLSEAKKLNDSQAPK | 1271 |
| Z14896 | VDAKYAKEERVAWNEIHKLPNLTISQMAAFITKLFDDPSQSSELLSEAKKLNDSQAPK | 1272 |
| Z14897 | VDAKYAKEEAHAWTEIHALPNLTIEQMAAFITKLFDDPSQSSELLSEAKKLNDSQAPK | 1273 |
| Z14898 | VDAKYAKEEYDAWVEIHLLPNLTINQMAAFITKLFDDPSQSSELLSEAKKLNDSQAPK | 1274 |
| Z14899 | VDAKYAKEEYRAWMEIHLLPNLTIEQMAAFITKLFDDPSQSSELLSEAKKLNDSQAPK | 1275 |
| Z14900 | VDAKYAKEESAAWTEIHLLPNLTIEQMAAFITKLFDDPSQSSELLSEAKKLNDSQAPK | 1276 |
| Z14901 | VDAKYAKEEYFAWTEIHVLPNLTVKQIAAFITKLFDDPSQSSELLSEAKKLNDSQAPK | 1277 |
| Z14902 | VDAKYAKEEFHAWSEIHLLPNLTVSQMAAFISKLFDDPSQSSELLSEAKKLNDSQAPK | 1278 |
| Z14903 | VDAKYAKEEYDAWTEIHALPNLTVDQMAAFITKLFDDPSQSSELLSEAKKLNDSQAPK | 1279 |
| Z14904 | VDAKYAKEEKAAWFEIHNLPNLTISQMAAFITKLFDDPSQSSELLSEAKKLNDSQAPK | 1280 |
| Z14905 | VDAKYAKEEYQAWIEIHALPNLTIEQMAAFITKLFDDPSQSSELLSEAKKLNDSQAPK | 1281 |
| Z14906 | VDAKYAKEEYDAWVEIHLLPNLTINQMAAFITKLFDDPSQSSELLSEAKKLNDSQAPK | 1282 |
| Z14907 | VDAKYAKEEQSAWMEIHILPNLTVSQIAAFISKLFDDPSQSSELLSEAKKLNDSQAPK | 1283 |
| Z14908 | VDAKYAKEERAAWNEIHSLPNLTVEQMAAFITKLFDDPSQSSELLSEAKKLNDSQAPK | 1284 |
| Z14909 | VDAKYAKEEHEAWNEIHKLPNLTIDQMAAFITKLFDDPSQSSELLSEAKKLNDSQAPK | 1285 |
| Z14910 | VDAKYAKEERFAWWEIHRLPNLTVRQVAAFITKLFDDPSQSSELLSEAKKLNDSQAPK | 1286 |
| Z14911 | VDAKYAKEEKDAWNEIHRLPNLTVDQVAAFITKLFDDPSQSSELLSEAKKLNDSQAPK | 1287 |

FIG. 1NN

| Designation | Sequence | SEQ ID NO |
|---|---|---|
| Z14912 | VDAKYAKEEARAWYEIHVLPNLTVHQIAAFITKLFDDPSQSSELLSEAKKLNDSQAPK | 1288 |
| Z14913 | VDAKYAKEERRAWNEIHKLPNLTVEQMAAFITKLFDDPSQSSELLSEAKKLNDSQAPK | 1289 |
| Z14914 | VDAKYAKEEYMAWDEIHRLPNLTVEQMAAFITKLFDDPSQSSELLSEAKKLNDSQAPK | 1290 |
| Z14915 | VDAKYAKEERNAWFEIHALPNLTIDQMAAFITKLFDDPSQSSELLSEAKKLNDSQAPK | 1291 |
| Z14916 | VDAKYAKEEAEAWQEIHLLPNLTVGQMAAFISKLFDDPSQSSELLSEAKKLNDSQAPK | 1292 |
| Z14917 | VDAKYAKEEKNAWYEIHLLPNLTIQQMAAFISKLFDDPSQSSELLSEAKKLNDSQAPK | 1293 |
| Z14918 | VDAKYAKEEAIAWHEIHLLPNLTITQMAAFITKLFDDPSQSSELLSEAKKLNDSQAPK | 1294 |
| Z14919 | VDAKYAKEEKDAWEEIHRLPNLTVTQMAAFISKLFDDPSQSSELLSEAKKLNDSQAPK | 1295 |
| Z14920 | VDAKYAKEEYDAWFEIHLLPNLTVQIAAFITKLFDDPSQSSELLSEAKKLNDSQAPK | 1296 |
| Z14921 | VDAKYAKEEAAAWMEIHLLPNLTVEQMAAFITKLFDDPSQSSELLSEAKKLNDSQAPK | 1297 |
| Z14922 | VDAKYAKEERKAWNEIHQLPNLTIQQVAAFITKLFDDPSQSSELLSEAKKLNDSQAPK | 1298 |
| Z14923 | VDAKYAKEEYAAWWEIHALPNLTVEQVAAFITKLFDDPSQSSELLSEAKKLNDSQAPK | 1299 |
| Z14924 | VDAKYAKEEKEAWMEIHILPNLTIDQMAAFITKLFDDPSQSSELLSEAKKLNDSQAPK | 1300 |
| Z14925 | VDAKYAKEEKIAWKEIHLLPNLTISQMAAFITKLFDDPSQSSELLSEAKKLNDSQAPK | 1301 |
| Z14926 | VDAKYAKEEHAAWMEIHLLPNLTVDQMAAFITKLFDDPSQSSELLSEAKKLNDSQAPK | 1302 |
| Z14927 | VDAKYAKEEKDAWYEIHIIPNLTVDQMAAFITKLFDDPSQSSELLSEAKKLNDSQAPK | 1303 |
| Z14928 | VDAKYAKEERAAWNEIHKLPNLTIEQMAAFITKLFDDPSQSSELLSEAKKLNDSQAPK | 1304 |
| Z14930 | VDAKYAKEEAAAWFEIHILLPNLTVGQIAAFITKLFDDPSQSSELLSEAKKLNDSQAPK | 1305 |
| Z14931 | VDAKYAKEEKFAWTEIHNLPNLTVDQMAAFITKLFDDPSQSSELLSEAKKLNDSQAPK | 1306 |
| Z14932 | VDAKYAKEEWLAWNEIHLLPNLTVDQMAAFITKLFDDPSQSSELLSEAKKLNDSQAPK | 1307 |
| Z14933 | VDAKYAKEEQRAWREIHILPNLTIDQMAAFITKLFDDPSQSSELLSEAKKLNDSQAPK | 1308 |
| Z14934 | VDAKYAKEEFQAWREIHLLPNLTIEQMAAFITKLFDDPSQSSELLSEAKKLNDSQAPK | 1309 |
| Z14935 | VDAKYAKEERMAWHEIHILPNLTVSQVAAFITKLFDDPSQSSELLSEAKKLNDSQAPK | 1310 |
| Z14936 | VDAKYAKEEKKAWYEIHILPNLTVNQIAAFITKLFDDPSQSSELLSEAKKLNDSQAPK | 1311 |
| Z14937 | VDAKYAKEEYYAWNEIHKLPNLTIVIQVAAFITKLFDDPSQSSELLSEAKKLNDSQAPK | 1312 |
| Z14938 | VDAKYAKEEADAWREIHLLPNLTLEQMAAFITKLFDDPSQSSELLSEAKKLNDSQAPK | 1313 |
| Z14939 | VDAKYAKEEYEAWNEIHRLPNLTIDQMAAFITKLFDDPSQSSELLSEAKKLNDSQAPK | 1314 |
| Z14940 | VDAKYAKEEKKAWWEIHALPNLTVNQVAAFITKLFDDPSQSSELLSEAKKLNDSQAPK | 1315 |
| Z14941 | VDAKYAKEEKTAWREIHLLPNLTIEQMAAFITKLFDDPSQSSELLSEAKKLNDSQAPK | 1316 |
| Z14942 | VDAKYAKEEKDAWYEIHLLPNLTVDQIAAFITKLFDDPSQSSELLSEAKKLNDSQAPK | 1317 |
| Z14943 | VDAKYAKEEYTAWYEIHILPNLTIKQMAAFISKLFDDPSQSSELLSEAKKLNDSQAPK | 1318 |
| Z14945 | VDAKYAKEEYHAWYEIHLLPNLTIEQIAAFITKLFDDPSQSSELLSEAKKLNDSQAPK | 1319 |
| Z14946 | VDAKYAKEEAHAWREIHLLPNLTVLQMAAFITKLFDDPSQSSELLSEAKKLNDSQAPK | 1320 |

FIG. 100

| Designation | Sequence | SEQ ID NO |
|---|---|---|
| Z14947 | VDAKYAKEEYEAWNEIHKLPNLTIDQMAAFITKLFDDPSQSSELLSEAKKLNDSQAPK | 1321 |
| Z14948 | VDAKYAKEERAAWNEIHALPNLTIDQMAAFITKLFDDPSQSSELLSEAKKLNDSQAPK | 1322 |
| Z14949 | VDAKYAKEEFDAWVEIHLLPNLTIDQMAAFITKLFDDPSQSSELLSEAKKLNDSQAPK | 1323 |
| Z14950 | VDAKYAKEEKAAWKEIHILPNLTVDQMAAFITKLFDDPSQSSELLSEAKKLNDSQAPK | 1324 |
| Z14951 | VDAKYAKEEWDAWLEIHALPNLTVDQVAAFISKLFDDPSQSSELLSEAKKLNDSQAPK | 1325 |
| Z14953 | VDAKYAKEEYNAWYEIHSLPNLTVEQMAAFITKLFDDPSQSSELLSEAKKLNDSQAPK | 1326 |
| Z14954 | VDAKYAKEEWNAWNEIHKLPNLTVEQMAAFITKLFDDPSQSSELLSEAKKLNDSQAPK | 1327 |
| Z14955 | VDAKYAKEEKEAWFEIHILPNLTVEQIAAFISKLFDDPSQSSELLSEAKKLNDSQAPK | 1328 |
| Z14956 | VDAKYAKEEATAWWEIHKLPNLTVQQVAAFISKLFDDPSQSSELLSEAKKLNDSQAPK | 1329 |
| Z14957 | VDAKYAKEEYEAWYEIHILPNLTVGQIAAFITKLFDDPSQSSELLSEAKKLNDSQAPK | 1330 |
| Z14958 | VDAKYAKEEANAWKEIHLLPNLTVGQVAAFITKLFDDPSQSSELLSEAKKLNDSQAPK | 1331 |
| Z14959 | VDAKYAKEEKRAWHEIHVLPNLTVEQIAAFITKLFDDPSQSSELLSEAKKLNDSQAPK | 1332 |
| Z14960 | VDAKYAKEEYDAWVEIHLLPNLTIDQIAAFITKLFDDPSQSSELLSEAKKLNDSQAPK | 1333 |
| Z14961 | VDAKYAKEEAEAWFEIHILPNLTINQIAAFITKLFDDPSQSSELLSEAKKLNDSQAPK | 1334 |
| Z14962 | VDAKYAKEEWHAWNEIHKLPNLTIDQMAAFITKLFDDPSQSSELLSEAKKLNDSQAPK | 1335 |
| Z14963 | VDAKYAKEEYEAWFEIHILPNLTVDQIAAFITKLFDDPSQSSELLSEAKKLNDSQAPK | 1336 |
| Z14964 | VDAKYAKEEYAWVEIHKLPNLTVEQVAAFITKLFDDPSQSSELLSEAKKLNDSQAPK | 1337 |
| Z14965 | VDAKYAKEERAAWFEIHILPNLTVSQMAAFITKLFDDPSQSSELLSEAKKLNDSQAPK | 1338 |
| Z14966 | VDAKYAKEEAQAWKEIHLLPNLTIEQMAAFISKLFDDPSQSSELLSEAKKLNDSQAPK | 1339 |
| Z14967 | VDAKYAKEEKAAWFEIHILPNLTIEQHMAAFITKLFDDPSQSSELLSEAKKLNDSQAPK | 1340 |
| Z14968 | VDAKYAKEEYAWIEIHNLPNLTIEQVAAFITKLFDDPSQSSELLSEAKKLNDSQAPK | 1341 |
| Z14969 | VDAKYAKEEKYAWVEIHKLPNLTVEQVAAFITKLFDDPSQSSELLSEAKKLNDSQAPK | 1342 |
| Z14970 | VDAKYAKEEYHAWWEIHLLPNLTIDQIAAFITKLFDDPSQSSELLSEAKKLNDSQAPK | 1343 |
| Z14971 | VDAKYAKEEKAAWNEIHLLPNLTIDQMAAFITKLFDDPSQSSELLSEAKKLNDSQAPK | 1344 |
| Z14972 | VDAKYAKEERAWIEIHILPNLTVEQMAAFISKLFDDPSQSSELLSEAKKLNDSQAPK | 1345 |
| Z14973 | VDAKYAKEEHDAWFEIHILPNLTVEQIAAFITKLFDDPSQSSELLSEAKKLNDSQAPK | 1346 |
| Z14974 | VDAKYAKEERNAWMEIHLLPNLTVDQMAAFITKLFDDPSQSSELLSEAKKLNDSQAPK | 1347 |
| Z14975 | VDAKYAKEEKHAWYEIHVLPNLTVGQMAAFITKLFDDPSQSSELLSEAKKLNDSQAPK | 1348 |
| Z14977 | VDAKYAKEEHDAWYEIHILPNLTVDQMAAFITKLFDDPSQSSELLSEAKKLNDSQAPK | 1349 |
| Z14978 | VDAKYAKEEAYAWREIHLLPNLTIHQMAAFITKLFDDPSQSSELLSEAKKLNDSQAPK | 1350 |
| Z14979 | VDAKYAKEEAAAWMEIHLLPNLTVNQMAAFITKLFDDPSQSSELLSEAKKLNDSQAPK | 1351 |
| Z14980 | VDAKYAKEEKEAWYEIHLLPNLTVDQMAAFITKLFDDPSQSSELLSEAKKLNDSQAPK | 1352 |
| Z14981 | VDAKYAKEEYQAWTEIHTLPNLTVDQMAAFITKLFDDPSQSSELLSEAKKLNDSQAPK | 1353 |

FIG. 1PP

| Designation | Sequence | SEQ ID NO |
|---|---|---|
| Z14982 | VDAKYAKEEKDAWYEIHLLPNLTVDQMAAFITKLFDDPSQSSELLSEAKKLNDSQAPK | 1354 |
| Z14983 | VDAKYAKEEANAWWEIHLLPNLTVEQMAAFITKLFDDPSQSSELLSEAKKLNDSQAPK | 1355 |
| Z14985 | VDAKYAKEEAKAWHEIHILPNLTITQMAAFITKLFDDPSQSSELLSEAKKLNDSQAPK | 1356 |
| Z14986 | VDAKYAKEEMSAWVEIHSLPNLTVSQIAAFITKLFDDPSQSSELLSEAKKLNDSQAPK | 1357 |
| Z14987 | VDAKYAKEERRAWYEIHILPNLTVEQMAAFITKLFDDPSQSSELLSEAKKLNDSQAPK | 1358 |
| Z14988 | VDAKYAKEEKDAWFEIHVLPNLTVDQMAAFITKLFDDPSQSSELLSEAKKLNDSQAPK | 1359 |
| Z14989 | VDAKYAKEEKRAWLEIHNLPNLTIDQMAAFISKLFDDPSQSSELLSEAKKLNDSQAPK | 1360 |
| Z14991 | VDAKYAKEEHGAWTEIHLLPNLTIEQVAAFITKLFDDPSQSSELLSEAKKLNDSQAPK | 1361 |
| Z14993 | VDAKYAKEERKAWIEIHLLPNLTIEQMAAFITKLFDDPSQSSELLSEAKKLNDSQAPK | 1362 |
| Z14994 | VDAKYAKEERSAWTEIHLLPNLTIDQMAAFITKLFDDPSQSSELLSEAKKLNDSQAPK | 1363 |
| Z14995 | VDAKYAKEELKAWTEIHNLPNLTIDQMAAFITKLFDDPSQSSELLSEAKKLNDSQAPK | 1364 |
| Z14996 | VDAKYAKEEANAWYEIHILPNLTVDQVAAFITKLFDDPSQSSELLSEAKKLNDSQAPK | 1365 |
| Z14997 | VDAKYAKEEWQAWWEIHALPNLTVEQVAAFITKLFDDPSQSSELLSEAKKLNDSQAPK | 1366 |
| Z14998 | VDAKYAKEEYNAWLEIHSLPNLTPNLTVTQMAAFITKLFDDPSQSSELLSEAKKLNDSQAPK | 1367 |
| Z14999 | VDAKYAKEEKKAWTEIHTLPNLTLPNLTVEQMAAFITKLFDDPSQSSELLSEAKKLNDSQAPK | 1368 |
| Z15000 | VDAKYAKEEKAAWYEIHLLPNLTPNLTVVQMAAFITKLFDDPSQSSELLSEAKKLNDSQAPK | 1369 |
| Z15001 | VDAKYAKEEKAAWREIHLLPNLTLPNLTINQMAAFITKLFDDPSQSSELLSEAKKLNDSQAPK | 1370 |
| Z15002 | VDAKYAKEEFEAWVEIHLLPNLTIEQIAAFITKLFDDPSQSSELLSEAKKLNDSQAPK | 1371 |
| Z15004 | VDAKYAKEEYAAWVEIHNLPNLTVEQMAAFITKLFDDPSQSSELLSEAKKLNDSQAPK | 1372 |
| Z15005 | VDAKYAKEESDAWYEIHTLPNLTINQMAAFISKLFDDPSQSSELLSEAKKLNDSQAPK | 1373 |
| Z15006 | VDAKYAKEEKFAWTEIHILPNLTVDQMAAFITKLFDDPSQSSELLSEAKKLNDSQAPK | 1374 |
| Z15007 | VDAKYAKEEAEAWWEIHILPNLTVSQIAAFISKLFDDPSQSSELLSEAKKLNDSQAPK | 1375 |
| Z15008 | VDAKYAKEEYQAWFEIHLLPNLTIDQMAAFITKLFDDPSQSSELLSEAKKLNDSQAPK | 1376 |
| Z15009 | VDAKYAKEEWEAWVEIHNLPNLTVHNLPNLTVDQMAAFITKLFDDPSQSSELLSEAKKLNDSQAPK | 1377 |
| Z15010 | VDAKYAKEEAKAWTEIHTLPNLTVDQMAAFITKLFDDPSQSSELLSEAKKLNDSQAPK | 1378 |
| Z15011 | VDAKYAKEEQLAWTEIHKLPNLTIDQMAAFITKLFDDPSQSSELLSEAKKLNDSQAPK | 1379 |
| Z15012 | VDAKYAKEEYDAWTEIHLLPNLTIEQMAAFITKLFDDPSQSSELLSEAKKLNDSQAPK | 1380 |
| Z15013 | VDAKYAKEEWDAWVEIHTLPNLTVDQMAAFITKLFDDPSQSSELLSEAKKLNDSQAPK | 1381 |
| Z15014 | VDAKYAKEEFEAWHEIHILPNLTVQQMAAFITKLFDDPSQSSELLSEAKKLNDSQAPK | 1382 |
| Z15016 | VDAKYAKEEWEAWVEIHNLPNLTIDQMAAFITKLFDDPSQSSELLSEAKKLNDSQAPK | 1383 |
| Z15017 | VDAKYAKEERAAWWEIHGLPNLTVDQMAAFITKLFDDPSQSSELLSEAKKLNDSQAPK | 1384 |
| Z15018 | VDAKYAKEERDAWHEIHRLPNLTIEQMAAFISKLFDDPSQSSELLSEAKKLNDSQAPK | 1385 |
| Z15019 | VDAKYAKEEKTAWTEIHILPNLTIHQMAAFISKLFDDPSQSSELLSEAKKLNDSQAPK | 1386 |
| | VDAKYAKEEFDAWMEIHLLPNLTINQMAAFITKLFDDPSQSSELLSEAKKLNDSQAPK | |

FIG. 1QQ

| Designation | Sequence | SEQ ID NO |
|---|---|---|
| Z15020 | VDAKYAKEEHLAWVEIHNLPNLTVEQMAAFITKLFDDPSQSSELLSEAKKLNDSQAPK | 1387 |
| Z15021 | VDAKYAKEERHAWWEIHKLPNLTIEQMAAFITKLFDDPSQSSELLSEAKKLNDSQAPK | 1388 |
| Z15022 | VDAKYAKEEYDAWFEIHLLPNLTVEQMAAFITKLFDDPSQSSELLSEAKKLNDSQAPK | 1389 |
| Z15023 | VDAKYAKEEKWAWTEIHLLPNLTIEQMAAFISKLFDDPSQSSELLSEAKKLNDSQAPK | 1390 |
| Z15026 | VDAKYAKEEAKAWFEIHILPNLTIEQIAAFITKLFDDPSQSSELLSEAKKLNDSQAPK | 1391 |
| Z15027 | VDAKYAKEEYRAWTEIHLLPNLTIHQMAAFITKLFDDPSQSSELLSEAKKLNDSQAPK | 1392 |
| Z15028 | VDAKYAKEEKHAWTEIHILPNLTVEQMAAFITKLFDDPSQSSELLSEAKKLNDSQAPK | 1393 |
| Z15029 | VDAKYAKEEARAWTEIHTLPNLTIDQIAAFITKLFDDPSQSSELLSEAKKLNDSQAPK | 1394 |
| Z15030 | VDAKYAKEEYAAWVEIHSLPNLTVDQMAAFITKLFDDPSQSSELLSEAKKLNDSQAPK | 1395 |
| Z15032 | VDAKYAKEEYDAWYEIHLLPNLTINQMAAFITKLFDDPSQSSELLSEAKKLNDSQAPK | 1396 |
| Z15033 | VDAKYAKEEFNAWNEIHLLPNLTVTQMAAFITKLFDDPSQSSELLSEAKKLNDSQAPK | 1397 |
| Z15034 | VDAKYAKEEKAAWNEIHLLPNLTIDQMAAFISKLFDDPSQSSELLSEAKKLNDSQAPK | 1398 |
| Z15035 | VDAKYAKEERIAWFEIHILPNLTIKQMAAFISKLFDDPSQSSELLSEAKKLNDSQAPK | 1399 |
| Z15037 | VDAKYAKEEYKAWYEIHILPNLTVQQMAAFITKLFDDPSQSSELLSEAKKLNDSQAPK | 1400 |
| Z15038 | VDAKYAKEEQHAWYEIHILPNLTIDQMAAFITKLFDDPSQSSELLSEAKKLNDSQAPK | 1401 |
| Z15039 | VDAKYAKEERYAWFEIHALPNLTVSQMAAFITKLFDDPSQSSELLSEAKKLNDSQAPK | 1402 |
| Z15040 | VDAKYAKEEYKAWIEIHILPNLTIDQIAAFISKLFDDPSQSSELLSEAKKLNDSQAPK | 1403 |
| Z15041 | VDAKYAKEERTAWFEIHILPNLTVDQIAAFITKLFDDPSQSSELLSEAKKLNDSQAPK | 1404 |
| Z15043 | VDAKYAKEEKHAWWEIHILPNLTINQMAAFITKLFDDPSQSSELLSEAKKLNDSQAPK | 1405 |
| Z15044 | VDAKYAKEEKMAWFEIHVLPNLTISQIAAFITKLFDDPSQSSELLSEAKKLNDSQAPK | 1406 |
| Z15045 | VDAKYAKEEFDAWTEIHLLPNLTVDQMAAFITKLFDDPSQSSELLSEAKKLNDSQAPK | 1407 |
| Z15046 | VDAKYAKEERDAWFEIHRLPNLTVSQMAAFITKLFDDPSQSSELLSEAKKLNDSQAPK | 1408 |
| Z15047 | VDAKYAKEEAVAWTEIHILPNLTVEQVAAFITKLFDDPSQSSELLSEAKKLNDSQAPK | 1409 |
| Z15048 | VDAKYAKEEWYAWREIHILPNLTVEQMAAFITKLFDDPSQSSELLSEAKKLNDSQAPK | 1410 |
| Z15049 | VDAKYAKEEFHAWYEIHILPNLTIDQMAAFITKLFDDPSQSSELLSEAKKLNDSQAPK | 1411 |
| Z15050 | VDAKYAKEEYEAWTEIHLLPNLTINQMAAFITKLFDDPSQSSELLSEAKKLNDSQAPK | 1412 |
| Z15051 | VDAKYAKEEWDAWTEIHALPNLTIDQMAAFITKLFDDPSQSSELLSEAKKLNDSQAPK | 1413 |
| Z15052 | VDAKYAKEESEAWTEIHLLPNLTIDQMAAFITKLFDDPSQSSELLSEAKKLNDSQAPK | 1414 |
| Z15054 | VDAKYAKEEFTAWSEIHNLPNLTVEQMAAFITKLFDDPSQSSELLSEAKKLNDSQAPK | 1415 |
| Z15055 | VDAKYAKEEADAWHEIHILPNLTVEQMAAFITKLFDDPSQSSELLSEAKKLNDSQAPK | 1416 |
| Z15056 | VDAKYAKEEKAAWFEIHILPNLTVDQMAAFITKLFDDPSQSSELLSEAKKLNDSQAPK | 1417 |
| Z15058 | VDAKYAKEERRAWHEIHILPNLTVEQMAAFISKLFDDPSQSSELLSEAKKLNDSQAPK | 1418 |
| Z15059 | VDAKYAKEERDAWWEIHKLPNLTVDQMAAFITKLFDDPSQSSELLSEAKKLNDSQAPK | 1419 |

FIG. 1RR

| Designation | Sequence | SEQ ID NO |
|---|---|---|
| Z15060 | VDAKYAKEEAYAWKEIHILPNLTIDQMAAFISKLFDDPSQSSELLSEAKKLNDSQAPK | 1420 |
| Z15061 | VDAKYAKEERAAWTEIHNLPNLTIDQMAAFITKLFDDPSQSSELLSEAKKLNDSQAPK | 1421 |
| Z15062 | VDAKYAKEEYAAWTEIHKLPNLTIDQMAAFITKLFDDPSQSSELLSEAKKLNDSQAPK | 1422 |
| Z15063 | VDAKYAKEERTAWMEIHGLPNLTIEQMAAFISKLFDDPSQSSELLSEAKKLNDSQAPK | 1423 |
| Z15064 | VDAKYAKEEWTAWMEIHLLPNLTIEQMAAFITKLFDDPSQSSELLSEAKKLNDSQAPK | 1424 |
| Z15065 | VDAKYAKEEKDAWFEIHILPNLTVHQIAAFISKLFDDPSQSSELLSEAKKLNDSQAPK | 1425 |
| Z15066 | VDAKYAKEEKSAWREIHLLPNLTIEQMAAFISKLFDDPSQSSELLSEAKKLNDSQAPK | 1426 |
| Z15068 | VDAKYAKEEYTAWLEIHALPNLTITQMAAFITKLFDDPSQSSELLSEAKKLNDSQAPK | 1427 |
| Z15069 | VDAKYAKEEKMAWMEIHKLPNLTIDQMAAFITKLFDDPSQSSELLSEAKKLNDSQAPK | 1428 |
| Z15070 | VDAKYAKEEYHAWYEIHLLPNLTVEQIAAFITKLFDDPSQSSELLSEAKKLNDSQAPK | 1429 |
| Z15071 | VDAKYAKEEKDAWFEIHALPNLTVDQMAAFITKLFDDPSQSSELLSEAKKLNDSQAPK | 1430 |
| Z15072 | VDAKYAKEEIRAAWFEIHLLPNLTVEQMAAFITKLFDDPSQSSELLSEAKKLNDSQAPK | 1431 |
| Z15073 | VDAKYAKEEYMAWLEIHNLPNLTVEQMAAFITKLFDDPSQSSELLSEAKKLNDSQAPK | 1432 |
| Z15074 | VDAKYAKEEYTAWREIHLLPNLTIDQMAAFISKLFDDPSQSSELLSEAKKLNDSQAPK | 1433 |
| Z15075 | VDAKYAKEEKAAWHEIHVLPNLTISQMAAFITKLFDDPSQSSELLSEAKKLNDSQAPK | 1434 |
| Z15076 | VDAKYAKEEWQAWNEIHLLPNLTIEQMAAFITKLFDDPSQSSELLSEAKKLNDSQAPK | 1435 |
| Z15078 | VDAKYAKEEWEAWFEIHLLPNLTISQMAAFISKLFDDPSQSSELLSEAKKLNDSQAPK | 1436 |
| Z15080 | VDAKYAKEEYHAWWEIHKLPNLTIEQMAAFITKLFDDPSQSSELLSEAKKLNDSQAPK | 1437 |
| Z15081 | VDAKYAKEEYAAWVEIHALPNLTVEQMAAFITKLFDDPSQSSELLSEAKKLNDSQAPK | 1438 |
| Z15083 | VDAKYAKEERMAWHEIHILPNLTVQQMAAFISKLFDDPSQSSELLSEAKKLNDSQAPK | 1439 |
| Z15084 | VDAKYAKEERDAWYEIHNLPNLTIDQMAAFITKLFDDPSQSSELLSEAKKLNDSQAPK | 1440 |
| Z15085 | VDAKYAKEESYAWWEIHKLPNLTIVEQMAAFITKLFDDPSQSSELLSEAKKLNDSQAPK | 1441 |
| Z15086 | VDAKYAKEEKRAWKEIHILPNLTIHALPNLTVEQIAAFITKLFDDPSQSSELLSEAKKLNDSQAPK | 1442 |
| Z15087 | VDAKYAKEEKEAWFEIHALPNLTVEQIAAFITKLFDDPSQSSELLSEAKKLNDSQAPK | 1443 |
| Z15088 | VDAKYAKEEYEAWNEIHLLPNLTVSQMAAFISKLFDDPSQSSELLSEAKKLNDSQAPK | 1444 |
| Z15089 | VDAKYAKEEAAAWMEIHLLPNLTIDQMAAFITKLFDDPSQSSELLSEAKKLNDSQAPK | 1445 |
| Z15090 | VDAKYAKEERNAWEEIHLLPNLTINQIAAFITKLFDDPSQSSELLSEAKKLNDSQAPK | 1446 |
| Z15091 | VDAKYAKEEYAWHEIHILPNLTVDQMAAFITKLFDDPSQSSELLSEAKKLNDSQAPK | 1447 |
| Z15092 | VDAKYAKEEANAWFEIHVLPNLTVEQMAAFISKLFDDPSQSSELLSEAKKLNDSQAPK | 1448 |
| Z15093 | VDAKYAKEEKNAWTEIHKLPNLTVDQMAAFITKLFDDPSQSSELLSEAKKLNDSQAPK | 1449 |
| Z15094 | VDAKYAKEEYDAWYEIHLLPNLTISQMAAFISKLFDDPSQSSELLSEAKKLNDSQAPK | 1450 |
| Z15095 | VDAKYAKEERLAWAEIHKLPNLTIEQVAAFISKLFDDPSQSSELLSEAKKLNDSQAPK | 1451 |
| Z15096 | VDAKYAKEERAAWNEIHILPNLTVQQMAAFITKLFDDPSQSSELLSEAKKLNDSQAPK | 1452 |

FIG. 1SS

| Designation | Sequence | SEQ ID NO |
|---|---|---|
| Z15098 | VDAKYAKEEAAAWDEIHRLPNLTVDQIAAFITKLFDDPSQSSELLSEAKKLNDSQAPK | 1453 |
| Z15099 | VDAKYAKEEKEAWWEIHGLPNLTVNQMAAFITKLFDDPSQSSELLSEAKKLNDSQAPK | 1454 |
| Z15100 | VDAKYAKEERKAWYEIHTLPNLTINQMAAFITKLFDDPSQSSELLSEAKKLNDSQAPK | 1455 |
| Z15101 | VDAKYAKEERRNAWYEIHILPNLTIEQMAAFITKLFDDPSQSSELLSEAKKLNDSQAPK | 1456 |
| Z15103 | VDAKYAKEEKLAWMEIHLLPNLTIEQMAAFITKLFDDPSQSSELLSEAKKLNDSQAPK | 1457 |
| Z15104 | VDAKYAKEEYMAWLEIHNLPNLTVDQMAAFITKLFDDPSQSSELLSEAKKLNDSQAPK | 1458 |
| Z15105 | VDAKYAKEESDAWREIHLLPNLTIEQMAAFISKLFDDPSQSSELLSEAKKLNDSQAPK | 1459 |
| Z15106 | VDAKYAKEEKEAWYEIHQLPNLTVNQMAAFISKLFDDPSQSSELLSEAKKLNDSQAPK | 1460 |
| Z15107 | VDAKYAKEEKQAWYEIHNLPNLTINQMAAFITKLFDDPSQSSELLSEAKKLNDSQAPK | 1461 |
| Z15108 | VDAKYAKEEYEAWTEIHRLPNLTIDQMAAFITKLFDDPSQSSELLSEAKKLNDSQAPK | 1462 |
| Z15109 | VDAKYAKEEKDAWYEIHVLPNLTISQMAAFITKLFDDPSQSSELLSEAKKLNDSQAPK | 1463 |
| Z15112 | VDAKYAKEERIAWYEIHILPNLTISQMAAFITKLFDDPSQSSELLSEAKKLNDSQAPK | 1464 |
| Z15113 | VDAKYAKEEQYAWTEIHLLPNLTIDQMAAFITKLFDDPSQSSELLSEAKKLNDSQAPK | 1465 |
| Z15114 | VDAKYAKEESDAWWEIHKLPNLTIDQMAAFITKLFDDPSQSSELLSEAKKLNDSQAPK | 1466 |
| Z15115 | VDAKYAKEEKFAWNEIHLLPNLTIEQMAAFITKLFDDPSQSSELLSEAKKLNDSQAPK | 1467 |
| Z15116 | VDAKYAKEERAAWYEIHILPNLTVNQIAAFITKLFDDPSQSSELLSEAKKLNDSQAPK | 1468 |
| Z15118 | VDAKYAKEEFHAWWEIHLLPNLTVEQVAAFITKLFDDPSQSSELLSEAKKLNDSQAPK | 1469 |
| Z15119 | VDAKYAKEEKQAWLEIHILPNLTVDQIAAFITKLFDDPSQSSELLSEAKKLNDSQAPK | 1470 |
| Z15120 | VDAKYAKEEHLAWTEIHLLPNLTINQMAAFITKLFDDPSQSSELLSEAKKLNDSQAPK | 1471 |
| Z15121 | VDAKYAKEEATAWREIHLLPNLTINQMAAFITKLFDDPSQSSELLSEAKKLNDSQAPK | 1472 |
| Z15123 | VDAKYAKEEKRAWYEIHILPNLTVEQVAAFITKLFDDPSQSSELLSEAKKLNDSQAPK | 1473 |
| Z15124 | VDAKYAKEEYEAWTEIHLLPNLTVSQMAAFITKLFDDPSQSSELLSEAKKLNDSQAPK | 1474 |
| Z15125 | VDAKYAKEESNAWWEIHKLPNLTVNQVAAFITKLFDDPSQSSELLSEAKKLNDSQAPK | 1475 |
| Z15127 | VDAKYAKEEKRAWMEIHLLPNLTVDQIAAFITKLFDDPSQSSELLSEAKKLNDSQAPK | 1476 |
| Z15128 | VDAKYAKEEKFAWKEIHILPNLTVDQIAAFITKLFDDPSQSSELLSEAKKLNDSQAPK | 1477 |
| Z15130 | VDAKYAKEERDAWFEIHVLPNLTILQMAAFITKLFDDPSQSSELLSEAKKLNDSQAPK | 1478 |
| Z15131 | VDAKYAKEEHYAWTEIHILPNLTVNQMAAFITKLFDDPSQSSELLSEAKKLNDSQAPK | 1479 |
| Z15132 | VDAKYAKEEKRAWMEIHLLPNLTVHQMAAFITKLFDDPSQSSELLSEAKKLNDSQAPK | 1480 |
| Z15133 | VDAKYAKEEYDAWVEIHLLPNLTVEQIAAFITKLFDDPSQSSELLSEAKKLNDSQAPK | 1481 |
| Z15134 | VDAKYAKEEHTAWFEIHILPNLTISQIAAFITKLFDDPSQSSELLSEAKKLNDSQAPK | 1482 |
| Z15135 | VDAKYAKEELQAWKEIHILPNLTVDQIAAFITKLFDDPSQSSELLSEAKKLNDSQAPK | 1483 |
| Z15136 | VDAKYAKEEYDAWLEIHLLPNLTISQMAAFITKLFDDPSQSSELLSEAKKLNDSQAPK | 1484 |
| Z15137 | VDAKYAKEEARAWREIHILPNLTVEQMAAFITKLFDDPSQSSELLSEAKKLNDSQAPK | 1485 |

FIG. 1TT

| Designation | Sequence | SEQ ID NO |
|---|---|---|
| Z15138 | VDAKYAKEERNAWFEIHILPNLTIDQMAAFITKLFDDPSQSSELLSEAKKLNDSQAPK | 1486 |
| Z15139 | VDAKYAKEEAYAWHEIHVLPNLTIDQMAAFITKLFDDPSQSSELLSEAKKLNDSQAPK | 1487 |
| Z15143 | VDAKYAKEEYFAWTEIHKLPNLTINQMAAFITKLFDDPSQSSELLSEAKKLNDSQAPK | 1488 |
| Z15144 | VDAKYAKEEAGAWYEIHLLPNLTVEQMAAFITKLFDDPSQSSELLSEAKKLNDSQAPK | 1489 |
| Z15146 | VDAKYAKEEKKAWYEIHILPNLTIEQMAAFISKLFDDPSQSSELLSEAKKLNDSQAPK | 1490 |
| Z15147 | VDAKYAKEEKQAWFEIHLLPNLTIEQMAAFISKLFDDPSQSSELLSEAKKLNDSQAPK | 1491 |
| Z15148 | VDAKYAKEEWHAWLEIHNLPNLTIEQMAAFITKLFDDPSQSSELLSEAKKLNDSQAPK | 1492 |
| Z15149 | VDAKYAKEEKSAWIEIHNLPNLTINQMAAFITKLFDDPSQSSELLSEAKKLNDSQAPK | 1493 |
| Z15150 | VDAKYAKEEYQAWNEIHILPNLTINQIAAFITKLFDDPSQSSELLSEAKKLNDSQAPK | 1494 |
| Z15152 | VDAKYAKEEAYAWVEIHKLPNLTVTQVAAFISKLFDDPSQSSELLSEAKKLNDSQAPK | 1495 |
| Z15153 | VDAKYAKEEYDAWMEIHNLPNLTIEQMAAFITKLFDDPSQSSELLSEAKKLNDSQAPK | 1496 |
| Z15154 | VDAKYAKEEYEAWVEIHNLPNLTIEQIAAFITKLFDDPSQSSELLSEAKKLNDSQAPK | 1497 |
| Z15155 | VDAKYAKEEREAWNEIHLLPNLTIEQIAAFITKLFDDPSQSSELLSEAKKLNDSQAPK | 1498 |
| Z15156 | VDAKYAKEEKRAWYEIHILPNLTVDQMAAFITKLFDDPSQSSELLSEAKKLNDSQAPK | 1499 |
| Z15157 | VDAKYAKEEKEAWTEIHILPNLTIHQVAAFITKLFDDPSQSSELLSEAKKLNDSQAPK | 1500 |
| Z15161 | VDAKYAKEEFEAWFEIHKLPNLTIQILPNLTITQMAAFISKLFDDPSQSSELLSEAKKLNDSQAPK | 1501 |
| Z15163 | VDAKYAKEESQAWTEIHVLPNLTVQQMAAFITKLFDDPSQSSELLSEAKKLNDSQAPK | 1502 |
| Z06777 | VDAKYAKEERKAWFEIHLLPNLTIEQMAAFITKLFDDPSQSSELLSEAKKLNDSQAPK | 1503 |
| Z06779 | VDAKYAKEERSAWFEIHTLPNLTVQQIAAFIWKLYDDPSQSSELLSEAKKLNDSQAPK | 1504 |
| Z06789 | VDAKYAKEERQAWWEIHSLPNLTVDQMAAFIVKLMDDPSQSSELLSEAKKLNDSQAPK | 1505 |
| Z06791 | VDAKYAKEQAKAWWEIHVLPNLTVHQVAAFITKLFDDPSQSSELLSEAKKLNDSQAPK | 1506 |
| Z06792 | VDAKYAKEERDAWHEIQILPNLTITQMAAFISKLFDDPSQSSELLSEAKKLNDSQAPK | 1507 |
| Z06799 | VDAKYAKEEQRAWTEIHVLPNLTVQQMAAFITKLFDDPSQSSELLSEAKKLNDSQAPK | 1508 |
| Z06802 | VDAKYAKETQHAWWEIHKLPNLTVSQMAAFITKLFDDPSQSSELLSEAKKLNDSQAPK | 1509 |
| Z06805 | VDAKYAKEEDRTAWWEIHKLPNLTIAEQMAAFIVDQLVAFITKLFDDPSQSSELLSEAKKLNDSQAPK | 1510 |
| Z06809 | VDAKYAKEERDAWREIHALPNLTVDQLVAFITKLFDDPSQSSELLSEAKKLNDSQAPK | 1511 |
| Z06814 | VDAKYAKEEQRAWREIHLLPNLTIEQMAAFIWKLLDDPSQSSELLSEAKKLNDSQAPK | 1512 |
| Z06829 | VDAKYAKEEQRAWTEIHVLPNLTVSQMSAFITKLFDDPSQSSELLSEAKKLNDSQAPK | 1513 |
| Z06834 | VDAKYAKEEQHQAWNEIHLLPNLTVNQMAAFIVKLFDDPSQSSELLSEAKKLNDSQAPK | 1514 |
| Z06844 | VDAKYAKEEHAAWLEIHLLPNLTVKQMAAFIGKLMDDPSQSSELLSEAKKLNDSQAPK | 1515 |
| Z06776 | VDAKYAKEEQMAWFEIHLLPNLTVGQMAAFIQKLFDDPSQSSELLSEAKKLNDSQAPK | 1516 |
| Z06778 | VDAKYAKEERSAWFEIHILPNLTISQKSAFIVKLFDDPSQSSELLSEAKKLNDSQAPK | 1517 |
| Z06780 | VDAKYAKEERSAWYEIHLLPNLTADQMAAFIAKLFDDPSQSSELLSEAKKLNDSQAPK | 1518 |

FIG. 1UU

| Designation | Sequence | SEQ ID NO |
|---|---|---|
| Z06787 | VDAKYAKEEQRAWYEIHLLPNLTIEQLTAFIMKLMDDPSQSSELLSEAKKLNDSQAPK | 1519 |
| Z06788 | VDAKYAKEERQAWWEITILPNLTIEQVAAFITKLFDDPSQSSELLSEAKKLNDSQAPK | 1520 |
| Z06793 | VDAKYAKEDYEAWVEIHVLPNLTVEQKAAFIVKLFDDPSQSSELLSEAKKLNDSQAPK | 1521 |
| Z06794 | VDAKYAKEVYNAWHEIHVLPNLTTLQISAFISKLFDDPSQSSELLSEAKKLNDSQAPK | 1522 |
| Z06796 | VDAKYAKEERKAWWEIHLLPNLTIEQRTAAFIWKLLDDPSQSSELLSEAKKLNDSQAPK | 1523 |
| Z06797 | VDAKYAKEEQAAWWEIHMLPNLTIEQRTAFIIKLFDDPSQSSELLSEAKKLNDSQAPK | 1524 |
| Z06806 | VDAKYAKEEQTAWFEIHILPNLTVNQRVAFITKLFDDPSQSSELLSEAKKLNDSQAPK | 1525 |
| Z06808 | VDAKYAKEEALAWREIHLLPNLTTVQISAFIAKLLDDPSQSSELLSEAKKLNDSQAPK | 1526 |
| Z06810 | VDAKYAKEEKFAWTEIHLLPNLTIGQQAAFIWKLFDDPSQSSELLSEAKKLNDSQAPK | 1527 |
| Z06811 | VDAKYAKEERAAWWEIHVLPNLTVSQMYAFITKLFDDPSQSSELLSEAKKLNDSQAPK | 1528 |
| Z06812 | VDAKYAKEEQRAWYEIHLLPNLTVRQRGAFITKLFDDPSQSSELLSEAKKLNDSQAPK | 1529 |
| Z06815 | VDAKYAKEHRQAWWEIHLLPNLTIRQIAAFIAKLFDDPSQSSELLSEAKKLNDSQAPK | 1530 |
| Z06823 | VDAKYAKEEKVAWREIHVLPNLTVSQISAFITKLFDDPSQSSELLSEAKKLNDSQAPK | 1531 |
| Z06824 | VDAKYAKEEKHAWYEIHLLPNLTISQLSAFIMKLFDDPSQSSELLSEAKKLNDSQAPK | 1532 |
| Z06830 | VDAKYAKESAFAWWEIHLLPNLTVEQIAAFIWKLLDDPSQSSELLSEAKKLNDSQAPK | 1533 |
| Z06836 | VDAKYAKEEQVAWREIHVLPNLTVEQVKAFINKLFDDPSQSSELLSEAKKLNDSQAPK | 1534 |
| Z06838 | VDAKYAKEEMDAWTEIHILPNLTVEQMEAFIVKLFDDPSQSSELLSEAKKLNDSQAPK | 1535 |
| Z06839 | VDAKYAKEEGRAWYEIHALPNLTVEQMSAFINKLFDDPSQSSELLSEAKKLNDSQAPK | 1536 |
| Z06841 | VDAKYAKEERNAWFEIHTIPNLTFLSQITAFIWKLLDDPSQSSELLSEAKKLNDSQAPK | 1537 |
| Z06842 | VDAKYAKEEHNAWTEIHRLPNLTVKQTSAFIEKLFDDPSQSSELLSEAKKLNDSQAPK | 1538 |
| Z06845 | VDAKYAKEEFKAWWEIHVLPNLTADQVAAFIVKLFDDPSQSSELLSEAKKLNDSQAPK | 1539 |
| Z06846 | VDAKYAKEQHMAWTEIHLLPNLTVAQMAAFIVKLFDDPSQSSELLSEAKKLNDSQAPK | 1540 |
| Z06854 | VDAKYAKEEQRAWWEIHLLPNLTARQTAAFIWKLMDDPSQSSELLSEAKKLNDSQAPK | 1541 |
| Z06855 | VDAKYAKEEQKSAWTEIHLLPNLTVHQISAFIAKLLDDPSQSSELLSEAKKLNDSQAPK | 1542 |
| Z06856 | VDAKYAKEEHLAWKEIHKLPNLTVIQMAAFIAKLFDDPSQSSELLSEAKKLNDSQAPK | 1543 |
| Z06857 | VDAKYAKEERAAWWEIHMLPNLTADQMAAFIAKLFDDPSQSSELLSEAKKLNDSQAPK | 1544 |
| Z06859 | VDAKYAKEQRTAWWEIHILPNLTVKQLVAFINKLFDDPSQSSELLSEAKKLNDSQAPK | 1545 |
| Z06861 | VDAKYAKEQIAWFEIHLLPNLTVGQRTAFIVKLFDDPSQSSELLSEAKKLNDSQAPK | 1546 |
| Z06862 | VDAKYAKEERRAWFEISVLPNLTIVDPNLTVDQTAAFIMKLFDDPSQSSELLSEAKKLNDSQAPK | 1547 |
| Z06864 | VDAKYAKEEADAWMEIHILPNLTVLQRSAFIIKLFDDPSQSSELLSEAKKLNDSQAPK | 1548 |
| Z06865 | VDAKYAKEEREAWFEIHVLPNLTIKQISAFIHKLFDDPSQSSELLSEAKKLNDSQAPK | 1549 |
| Z06866 | VDAKYAKEERRAWFEIHTLPNLTVEQIEAFINKLFDDPSQSSELLSEAKKLNDSQAPK | 1550 |
| Z06871 | VDAKYAKEERAAWWEIHGLPNLTVWQTAAFIVKLFDDPSQSSELLSEAKKLNDSQAPK | 1551 |

FIG. 1VV

| Designation | Sequence | SEQ ID NO |
|---|---|---|
| Z03638 | AEAKYAKELGWATWEIFNLPNLTGVQVKAFIDKLRDDPSQSSELLSEAKKLNDSQAPK | 1552 |
| Z04726 | VDAKYAKELGWATWEIFNLPNLTGVQVKAFIDKLRDDPSQSSELLSEAKKLNDSQAPK | 1553 |
| PP013 | LAEAKEAANAELDSYGVSDFYKRLIDKAKTVEGVEALKDAILAALP | 1554 |
| hIL-6 | PVPPGEDSKDVAAPHRQPLTSSERIDKQIRYILDGISALRKETCNKSNMCESSKEALAENNLNLPKMAEKDGCFQSGF NEETCLVKIITGLLEFEVYLEYLQNRFESSEEQARAVQMSTKVLIQFLQKKAKNLDAITTPDPTTNASLLTKLQAQNQ WLQDMTTHLILRSFKEFLQSSLRALRQM | 1555 |
| mIL-6 | MFPTSQVRRGDFTEDTTPNRPVYTTSQVGGLITHVLWEIVEMRKELCNGNSDCMNNDDALAENNLKLPEIQRNDGCYQ TGYNQEICLLKISSGLLEYHSYLEYMKNNLKDNKKDKARVLQRDTETLIHIFNQEVKDLHKIVLPTPISNALLTDKLE SQKEWLRTKTIQFILKSLEEFLKVTLRSTRQT | 1556 |

POLYPEPTIDE

CROSS REFERENCE TO RELATED APPLICATIONS

This application is a National Stage application of PCT/EP2015/063362, filed Jun. 15, 2015, which claims priority to EP Application No. 14172331.2, filed Jun. 13, 2014, both of which are incorporated by reference in their entirety herein.

JOINT RESEARCH AGREEMENT

The presently claimed invention was made by or on behalf of the below listed parties to a joint research agreement. The joint research agreement was in effect on or before the date the claimed invention was made and the claimed invention was made as a result of activities undertaken within the scope of the joint research agreement. The parties to the joint research agreement are Affibody AB, Solna, SE and AbClon Inc., Seoul, KR.

FIELD OF THE INVENTION

The present disclosure relates to a class of engineered polypeptides having a binding affinity for interleukin-6 (in the following referred to as IL-6). The present disclosure also relates to the use of such an IL-6 binding polypeptide as a therapeutic, prognostic and/or diagnostic agent.

BACKGROUND

Inflammation is a cytokine-driven response by the innate immune system to destroy for example pathogens and damaged cells. In some disease conditions, such as rheumatoid arthritis (RA) and Crohn's disease, the regulation of the inflammatory system is impaired leading to tissue damages. Among the most studied inducers of inflammation are the cytokines interleukin-6 (IL-6) and tumor necrosis factor (TNF). IL-6 is also known as B cell Stimulatory Factor 2 (BSF2), Hepatocyte Stimulating Factor (HSF), Hybridoma Growth Factor (HGF) and interferon-beta 2 (IFNB2).

Human IL-6 consists of a single polypeptide chain of 184 amino acids with a molecular weight of 21 kDa, however a variable glycosylation pattern accounts for sizes varying between 21-26 kDa. IL-6 is secreted by a wide variety of cell types including T cells, B cells, monocytes, fibroblasts, hepatocytes, endothelial cells and keratinocytes. Downstream signaling induces the transition from acute inflammation to either acquired immunity or chronic inflammatory disease. IL-6 signaling and its regulation is complex and involves a number of factors and mechanisms. IL-6 signaling may occur via the classical IL-6 singling pathway, also known as the cis-signaling pathway, or via the trans-signaling pathway. In the classical IL-6 signaling pathway, circulating IL-6 binds to a membrane bound IL-6 receptor a (IL-6Rα) followed by recruitment of the membrane anchored gp130 co-receptor, which results in the formation of a ternary complex. This complex subsequently dimerizes with a second adjacent ternary complex leading to signal transduction via the gp130 moities (Boulanger et al., 2003, Science 300(5628): 2101-2104). In circulation, IL-6 can also exist as bound to soluble ectodomains of IL-6Rα. Such complexes are responsible for the trans-signaling mechanism, involving IL-6 dependent activation of any cells that express the co-receptor gp130 but lack IL-6Rα (Chalaris et al., 2011, Eur J Cell Biol 90(6-7): 484-494; Assier et al., 2010, Joint Bone Spine 77(6):532-6). The trans-signaling, or pro-inflammatory, pathway has been suggested to be the pathway most related to disease conditions, and thus the most preferable to block. In contrast, the classical signaling pathway is regarded as being responsible for important anti-inflammatory and regenerative processes (Scheller et al., 2011, Biochim Biophys Acta 1813(5): 878-888).

The anti-IL-6Rα antibody tocilizumab (Actemra®), has been approved for clinical use for IL-6 related disorders. Other drug candidates are also being developed in order to address different IL-6 triggered pathways. These include the antibodies CNTO136 (sirukumab) (Xu et al., 2011, Br J Clin Pharmacol 72(2): 270-281; Zhuang et al., 2013, Int J Clin Pharmacol Ther 51(3): 187-199) and MED15117 (Finch et al., 2011, J Mol Biol 411(4): 791-807), which bind to the IL-6 cytokine itself. Additionally the gp130-Fc fusion CR5/18, aimed at selectively blocking the trans-signaling pathway, is under development (Kopf et al., 2010, Nat Rev Drug Discov 9(9): 703-718; Chalaris et al., 2012, Dig Dis 30(5): 492-499).

The unpredictable and chronic nature of inflammatory diseases, as well as a high unmet medical need, warrants the development of new modes of treatment. Since tissue penetration rate is negatively associated with the size of the molecule, a relatively large antibody molecule inherently has poor tissue distribution and penetration capacity.

Thus, the use of monoclonal antibodies is not always optimal for therapy and there is continued need for provision of agents with a high affinity for IL-6. Of great interest is also the provision of uses of such molecules in the treatment, diagnosis and prognosis of IL-6 related disorders.

SUMMARY OF THE INVENTION

It is an object of the present disclosure to provide new IL-6 binding agents, which could for example be used for therapeutic, prognostic and diagnostic applications.

It is an object of the present disclosure to provide a molecule allowing for efficient therapy targeting various forms of inflammatory and autoimmune diseases while alleviating the abovementioned and other drawbacks of current therapies.

It is furthermore an object of the present disclosure to provide a molecule suitable for prognostic and diagnostic applications.

These and other objects, which are evident to the skilled person from the present disclosure, are met by different aspects of the invention as claimed in the appended claims and as generally disclosed herein.

Thus, in the first aspect of the disclosure, there is provided an IL-6 binding polypeptide, comprising an IL-6 binding motif BM, which motif consists of an amino acid sequence selected from:

(SEQ ID NO: 1562)
i) $EEX_3X_4AWX_7EIHX_{11}LPNLX_{16}X_{17}X_{18}QX_{20}X_{21}AFIX_{25}X_{26}LX_{28}X_{29}$ wherein, independently from each other,
$X_3$ is selected from A, F, H, K, Q, R, S, W and Y;
$X_4$ is selected from A, D, E, F, H, I, K, L, M, N, Q, R, S, T, V and Y;
$X_7$ is selected from F, H, I, K, L, M, N, R, S, T, V, W and Y;
$X_{11}$ is selected from A, I, K, L, M, N, R, S, T and V;
$X_{16}$ is selected from N and T;
$X_{17}$ is selected from A, I, T and V;

$X_{18}$ is selected from D, E, G, H, K, N, Q, R, S and T;
$X_{20}$ is selected from I, L, M, R, T and V;
$X_{21}$ is selected from A, S, T and V;
$X_{25}$ is selected from I, M, Q, S, T, V and W;
$X_{26}$ is selected from K and S;
$X_{28}$ is selected from F, L, M and Y; and
$X_{29}$ is selected from D and R;
and
ii) an amino acid sequence which has at least 93% identity to the sequence defined in i).

The above definition of a class of sequence related, IL-6 binding polypeptides is based on a statistical analysis of a number of random polypeptide variants of a parent scaffold, that were selected for their interaction with IL-6 in several different selection experiments. The identified IL-6 binding motif, or "BM", corresponds to the target binding region of the parent scaffold, which region constitutes two alpha helices within a three-helical bundle protein domain. In the parent scaffold, the varied amino acid residues of the two BM helices constitute a binding surface for interaction with the constant Fc part of antibodies. In the present disclosure, the random variation of binding surface residues and subsequent selection of variants have replaced the Fc interaction capacity with a capacity for interaction with IL-6.

As the skilled person will realize, the function of any polypeptide, such as the IL-6 binding capacity of the polypeptide of the present disclosure, is dependent on the tertiary structure of the polypeptide. It is therefore possible to make minor changes to the sequence of amino acids in a polypeptide without affecting the function thereof. Thus, the disclosure encompasses modified variants of the IL-6 binding polypeptide, which are such that the IL-6 binding characteristics are retained.

In this way, also encompassed by the present disclosure is an IL-6 binding polypeptide comprising an amino acid sequence with 93% or greater identity to a polypeptide as defined in i). In some embodiments, the polypeptide may comprise a sequence which is at least 96% identical to a polypeptide as defined in i). For example, it is possible that an amino acid residue belonging to a certain functional grouping of amino acid residues (e.g. hydrophobic, hydrophilic, polar etc) could be exchanged for another amino acid residue from the same functional group.

In some embodiments, such changes may be made in any position of the sequence of the IL-6 binding polypeptide as disclosed herein. In other embodiments, such changes may be made only in the non-variable positions, also denoted scaffold amino acid residues. In such cases, changes are not allowed in the variable positions, i.e. positions denoted with an "X" in sequence i).

The term "% identity", as used throughout the specification, may for example be calculated as follows. The query sequence is aligned to the target sequence using the CLUSTAL W algorithm (Thompson et al, Nucleic Acids Research, 22: 4673-4680 (1994)). A comparison is made over the window corresponding to the shortest of the aligned sequences. The shortest of the aligned sequences may in some instances be the target sequence. In other instances, the query sequence may constitute the shortest of the aligned sequences. The amino acid residues at each position are compared and the percentage of positions in the query sequence that have identical correspondences in the target sequence is reported as % identity.

As used herein "$X_n$" and "$X_m$" are used to indicate amino acids in positions n and m in the sequence i) as defined above, wherein n and m are integers which indicate the position of an amino acid within said sequence as counted from the N-terminal end of said sequence. For example, $X_3$ and $X_7$ indicate the amino acid in position three and seven, respectively, from the N-terminal end of sequence i).

In embodiments according to the first aspect, there are provided polypeptides wherein $X_n$ in sequence i) is independently selected from a group of possible residues according to Table 1. The skilled person will appreciate that $X_n$ may be selected from any one of the listed groups of possible residues and that this selection is independent from the selection of amino acids in $X_m$, wherein n≠m. Thus, any of the listed possible residues in position $X_n$ in Table 1 may be independently combined with any of the listed possible residues any other variable position in Table 1.

The skilled person will appreciate that Table 1 is to be read as follows: In one embodiment according to the first aspect, there is provided a polypeptide wherein amino acid residue "$X_n$" in sequence i) is selected from "Possible residues". Thus, Table 1 discloses several specific and individualized embodiments of the first aspect of the present disclosure. For example, in one embodiment according to the first aspect, there is provided a polypeptide wherein $X_3$ in sequence i) is selected from A, H, K, Q, R and Y, and in another embodiment according to the first aspect, there is provided a polypeptide wherein $X_3$ in sequence i) is selected from A, K, Q, R and Y. For avoidance of doubt, the listed embodiments may be freely combined in yet other embodiments. For example, one such combined embodiment is a polypeptide in which $X_3$ is selected from A, K, R and Y, while $X_4$ is selected from H and K, and $X_{11}$ is selected from A, I, L and T.

TABLE 1

Embodiments of the first aspect of the present disclosure

| $X_n$ | Possible residues |
|---|---|
| $X_3$ | A, F, H, K, Q, R, W, Y |
| $X_3$ | A, H, K, Q, R, S, W, Y |
| $X_3$ | A, H, K, Q, R, W, Y |
| $X_3$ | A, H, K, Q, R, Y |
| $X_3$ | A, K, Q, R, Y |
| $X_3$ | A, K, R, Y |
| $X_3$ | A, K, R |
| $X_3$ | A, R, Y |
| $X_3$ | K, R |
| $X_3$ | A, R |
| $X_3$ | R, Y |
| $X_3$ | R |
| $X_3$ | K |
| $X_3$ | A |
| $X_3$ | Y |
| $X_4$ | A, D, E, F, H, K, L, M, N, Q, R, S, T, V, Y |
| $X_4$ | A, D, E, F, H, I, K, M, N, Q, R, S, T, V, Y |
| $X_4$ | A, D, E, F, H, K, L, M, N, Q, R |
| $X_4$ | A, D, E, F, H, K, M, N, Q, R, S, T, V, Y |
| $X_4$ | A, D, E, F, H, K, N, Q, R, S, T, Y |
| $X_4$ | A, D, E, H, K, N, Q, R, S, T, Y |
| $X_4$ | A, D, E, H, K, Q, R, T |
| $X_4$ | A, D, E, F, H, K, M, Q, R, S, T, V, Y |
| $X_4$ | A, D, E, F, H, K, Q, R, S, T, V |
| $X_4$ | A, D, E, H, K, Q, R |
| $X_4$ | A, D, E, H, K, R |
| $X_4$ | D, E, H, K, R |
| $X_4$ | A, D, E, K, R |
| $X_4$ | A, D, E, H, K |
| $X_4$ | D, E, K, R |
| $X_4$ | A, D, E, K |
| $X_4$ | D, E, H, K |
| $X_4$ | D, H, K, Q |
| $X_4$ | E, H, K, R |
| $X_4$ | D, E, R |
| $X_4$ | D, E, K |
| $X_4$ | H, K, Q |

TABLE 1-continued Embodiments of the first aspect of the present disclosure

| $X_n$ | Possible residues |
|---|---|
| $X_4$ | D, K, Q |
| $X_4$ | D, H, Q |
| $X_4$ | D, H, K |
| $X_4$ | E, H, K |
| $X_4$ | E, H, R |
| $X_4$ | H, K, R |
| $X_4$ | K, E, R |
| $X_4$ | D, E |
| $X_4$ | R, E |
| $X_4$ | K, E |
| $X_4$ | E, H |
| $X_4$ | D, K |
| $X_4$ | H, K |
| $X_4$ | K, Q |
| $X_4$ | K, D |
| $X_4$ | D, Q |
| $X_4$ | H, Q |
| $X_4$ | K |
| $X_4$ | H |
| $X_4$ | D |
| $X_4$ | Q |
| $X_4$ | E |
| $X_4$ | R |
| $X_7$ | F, H, I, K, L, M, N, R, T, V, W, Y |
| $X_7$ | F, H, I, K, L, M, N, R, T, W, Y |
| $X_7$ | F, H, I, L, M, N, R, T, W, Y |
| $X_7$ | F, H, K, L, M, N, R, S, T, V, W, Y |
| $X_7$ | F, H, K, L, M, N, R, T, V, W, Y |
| $X_7$ | F, H, K, L, M, N, R, T, W, Y |
| $X_7$ | F, H, L, M, N, R, T, W, Y |
| $X_7$ | F, H, R, T, W, Y |
| $X_7$ | F, I, N, R, T, W, Y |
| $X_7$ | F, I, R, W, Y |
| $X_7$ | F, N, R, W, Y |
| $X_7$ | F, R, T, W, Y |
| $X_7$ | F, H, T, W, Y |
| $X_7$ | F, H, W, Y |
| $X_7$ | F, T, W, Y |
| $X_7$ | F, R, W, Y |
| $X_7$ | F, H, L, M, R, T, V, W, Y |
| $X_7$ | F, H, R, T, W, Y |
| $X_7$ | I, R, W, Y |
| $X_7$ | F, W, Y |
| $X_7$ | F, R, Y |
| $X_7$ | R, W, Y |
| $X_7$ | I, R, Y |
| $X_7$ | I, W, Y |
| $X_7$ | F, Y |
| $X_7$ | W, Y |
| $X_7$ | I, Y |
| $X_7$ | R, Y |
| $X_7$ | F |
| $X_7$ | W |
| $X_7$ | Y |
| $X_7$ | I |
| $X_7$ | R |
| $X_{11}$ | A, I, K, L, N, R, S, T, V |
| $X_{11}$ | A, I, K, L, M, N, S, T, V |
| $X_{11}$ | A, I, K, L, N, S, T, V |
| $X_{11}$ | A, I, K, L, S, T, V |
| $X_{11}$ | A, I, K, L, N, T, V |
| $X_{11}$ | A, I, K, L, T, V |
| $X_{11}$ | A, I, K, L, T |
| $X_{11}$ | I, K, L, T |
| $X_{11}$ | A I, L, T |
| $X_{11}$ | A I, K, L |
| $X_{11}$ | A, K, L, N, S, T |
| $X_{11}$ | A, K, L, N, S |
| $X_{11}$ | A, K, L, S, T |
| $X_{11}$ | A, K, L, S |
| $X_{11}$ | K, L, S |
| $X_{11}$ | A, K, L |
| $X_{11}$ | A, I, L |
| $X_{11}$ | I, L |
| $X_{11}$ | A, L, N |
| $X_{11}$ | A, L |
| $X_{11}$ | L, N |
| $X_{11}$ | L |
| $X_{11}$ | A |
| $X_{11}$ | N |
| $X_{11}$ | S |
| $X_{11}$ | I |
| $X_{11}$ | K |
| $X_{11}$ | T |
| $X_{16}$ | N |
| $X_{16}$ | T |
| $X_{17}$ | I, T, V |
| $X_{17}$ | A, I, V |
| $X_{17}$ | I, V |
| $X_{17}$ | I |
| $X_{17}$ | V |
| $X_{18}$ | D, E, H, K, N, Q, R, S, T |
| $X_{18}$ | D, E, G, H, N, Q, R, S, T |
| $X_{18}$ | D, E, H, N, Q, R, S, T |
| $X_{18}$ | D, E, H, N, Q, S, T |
| $X_{18}$ | D, E, N, Q, S, T |
| $X_{18}$ | D, E, N, S, T |
| $X_{18}$ | D, E, Q, S, T |
| $X_{18}$ | D, E, S, T |
| $X_{18}$ | D, E, Q, S |
| $X_{18}$ | D, E, N, S |
| $X_{18}$ | D, E, S |
| $X_{18}$ | D, E, N |
| $X_{18}$ | D, E |
| $X_{18}$ | E |
| $X_{18}$ | D |
| $X_{20}$ | I, L, M, R, V |
| $X_{20}$ | I, M, R, T, V |
| $X_{20}$ | I, M, R, V |
| $X_{20}$ | I, L, M, V |
| $X_{20}$ | I, M, V |
| $X_{20}$ | I, M |
| $X_{20}$ | M, V |
| $X_{20}$ | M |
| $X_{21}$ | A, S, T |
| $X_{21}$ | A, S, V |
| $X_{21}$ | A, S |
| $X_{21}$ | A, V |
| $X_{21}$ | A, T |
| $X_{21}$ | A |
| $X_{25}$ | I, Q, S, T, V, W |
| $X_{25}$ | I, Q, S, T, V |
| $X_{25}$ | I, Q, S, T, W |
| $X_{25}$ | I, Q, S, T |
| $X_{25}$ | I, S, T |
| $X_{25}$ | Q, S, T |
| $X_{25}$ | S, T, W |
| $X_{25}$ | S, T |
| $X_{25}$ | S |
| $X_{25}$ | T |
| $X_{26}$ | K |
| $X_{26}$ | S |
| $X_{28}$ | F, L, Y |
| $X_{28}$ | F, M, Y |
| $X_{28}$ | F, L, M |
| $X_{28}$ | F, L |
| $X_{28}$ | F, Y |
| $X_{28}$ | F |
| $X_{29}$ | D |
| $X_{29}$ | R |

In one particular embodiment according to the first aspect, there is provided polypeptide wherein, in sequence i), $X_3$ is selected from A, H, K, Q, R and Y;

$X_4$ is selected from A, D, E, F, H, I, K, L, M, N, Q, R, S, T, V and Y;

$X_7$ is selected from F, H, I, K, L, M, N, R, T, V, W and Y;

$X_{11}$ is selected from A, I, K, L, N, S, T and V;

$X_{16}$ is T;

$X_{17}$ is selected from A, I, T and V;

$X_{18}$ is selected from D, E, H, K, N, Q, R, S and T;
$X_{20}$ is selected from I, L, M, R and V;
$X_{21}$ is selected from A, S and V;
$X_{25}$ is selected from I, Q, S, T, V and W;
$X_{26}$ is K;
$X_{28}$ is selected from F, L, M and Y; and
$X_{29}$ is D.

In a more specific embodiment defining a sub-class of IL-6 binding polypeptides, sequence i) fulfills at least six of the eleven conditions I-XI:
I. $X_3$ is selected from K and R;
II. $X_{11}$ is selected from A and L;
III. $X_{16}$ is T;
IV. $X_{17}$ is selected from I and V;
V. $X_{18}$ is selected from D and E;
VI. $X_{20}$ is M;
VII. $X_{21}$ is A;
VIII. $X_{25}$ is selected from S and T;
IX. $X_{26}$ is K;
X. $X_{28}$ is F; and
XI. $X_{29}$ is D.

In some examples of an IL-6 binding polypeptide according to the first aspect, sequence i) fulfils at least seven of the eleven conditions I-XI. More specifically, sequence i) may fulfill at least eight of the eleven conditions I-XI, such as at least nine of the eleven conditions I-XI, such as at least ten of the eleven conditions I-XI, such as all of the eleven conditions I-XI.

In some embodiments of an IL-6 binding polypeptide according to the first aspect, there is provided an IL-6 binding polypeptide, wherein $X_{17}X_{20}X_{21}$ is selected from VMA and IMA. In some embodiments, $X_{20}X_{21}X_{28}$ is MAF. In some embodiments, $X_{17}X_{20}X_{28}$ is selected from VMF and IMF. In some embodiments, $X_{17}X_{21}X_{28}$ is selected from VAF and IAF.

As described in detail in the experimental section to follow, the selection of IL-6 binding polypeptide variants has led to the identification of a number of individual IL-6 binding motif (BM) sequences. These sequences constitute individual embodiments of sequence i) according to this aspect. The sequences of individual IL-6 binding motifs correspond to amino acid positions 8-36 in SEQ ID NO:1-1551 presented in FIG. 1A-VV. Hence, in one embodiment of the IL-6 binding polypeptide according to this aspect, sequence i) corresponds to the sequence from position 8 to position 36 in a sequence selected from the group consisting of SEQ ID NO:1-1551. In one embodiment, sequence i) corresponds to the sequence from position 8 to position 36 in a sequence selected from the group consisting of SEQ ID NO:1-1502. In one embodiment, sequence i) corresponds to the sequence from position 8 to position 36 in a sequence selected from the group consisting of SEQ ID NO:7, SEQ ID NO:15-89 and SEQ ID NO:151-871. In one embodiment, sequence i) corresponds to the sequence from position 8 to position 36 in a sequence selected from the group consisting of SEQ ID NO:1-6, SEQ ID NO:8-14, SEQ ID NO:90-150 and SEQ ID NO:872-1502. In one embodiment, sequence i) corresponds to the sequence from position 8 to position 36 in a sequence selected from the group consisting of SEQ ID NO:1-152 and SEQ ID NO:1503-1515. In one embodiment, sequence i) corresponds to the sequence from position 8 to position 36 in a sequence selected from the group consisting of SEQ ID NO:1-150 and SEQ ID NO:1503-1515. In one embodiment, sequence i) corresponds to the sequence from position 8 to position 36 in a sequence selected from the group consisting of SEQ ID NO:1-152. In another embodiment, sequence i) corresponds to the sequence from position 8 to position 36 in a sequence selected from the group consisting of SEQ ID NO:1-150. In yet another embodiment, sequence i) corresponds to the sequence from position 8 to position 36 in a sequence selected from the group consisting of SEQ ID NO:7, SEQ ID NO:15-89 and SEQ ID NO:151-152. In one embodiment, sequence i) corresponds to the sequence from position 8 to position 36 in a sequence selected from the group consisting of SEQ ID NO:1-6, SEQ ID NO:8-14 and SEQ ID NO:90-150. In one embodiment, sequence i) corresponds to the sequence from position 8 to position 36 in a sequence selected from the group consisting of SEQ ID NO:1-14 and SEQ ID NO:1503-1515. In one embodiment, sequence i) corresponds to the sequence from position 8 to position 36 in a sequence selected from the group consisting of SEQ ID NO:1-14 and SEQ ID NO:1512. In one embodiment, sequence i) corresponds to the sequence from position 8 to position 36 in a sequence selected from the group consisting of SEQ ID NO:1-14. In one embodiment, sequence i) corresponds to the sequence from position 8 to position 36 in a sequence selected from the group consisting of SEQ ID NO:1-5. In one embodiment, sequence i) corresponds to the sequence from position 8 to position 36 in SEQ ID NO:1512. In specific individual embodiments, sequence i) corresponds to the sequence from position 8 to position 36 in any one of SEQ ID NO:1-14 individually.

In some embodiments of the present disclosure, the BM as defined above "forms part of" a three-helix bundle protein domain. This is understood to mean that the sequence of the BM is "inserted" into or "grafted" onto the sequence of the original three-helix bundle domain, such that the BM replaces a similar structural motif in the original domain. For example, without wishing to be bound by theory, the BM is thought to constitute two of the three helices of a three-helix bundle, and can therefore replace such a two-helix motif within any three-helix bundle. As the skilled person will realize, the replacement of two helices of the three-helix bundle domain by the two BM helices has to be performed so as not to affect the basic structure of the polypeptide. That is, the overall folding of the Cα backbone of the polypeptide according to this embodiment of the invention is substantially the same as that of the three-helix bundle protein domain of which it forms a part, e.g. having the same elements of secondary structure in the same order etc. Thus, a BM according to the disclosure "forms part" of a three-helix bundle domain if the polypeptide according to this embodiment of the aspect has the same fold as the original domain, implying that the basic structural properties are shared, those properties e.g. resulting in similar CD spectra. The skilled person is aware of other parameters that are relevant.

In particular embodiments, the IL-6 binding motif (BM) thus forms part of a three-helix bundle protein domain. For example, the BM may essentially constitute two alpha helices with an interconnecting loop, within said three-helix bundle protein domain. In particular embodiments, said three-helix bundle protein domain is selected from domains of bacterial receptor proteins. Non-limiting examples of such domains are the five different three-helical domains of Protein A from *Staphylococcus aureus*, such as domain B, and derivatives thereof. In some embodiments, the three-helical bundle protein domain is a variant of protein Z, which is derived from domain B of staphylococcal Protein A.

In some embodiments where the IL-6 binding polypeptide as disclosed herein forms part of a three-helix bundle protein domain, the IL-6 binding polypeptide may comprise a binding module (BMod), the amino acid sequence of which is selected from:

(SEQ ID NO: 1563)
iii) K-[BM]-DPSQSX$_a$X$_b$LLX$_c$EAKKLX$_d$X$_e$X$_f$Q;

wherein
[BM] is an IL-6 binding motif as defined herein, provided that X$_{29}$ is ID,
X$_a$ is selected from A and S;
X$_b$ is selected from N and E;
X$_c$ is selected from A, S and C;
X$_d$ is selected from E, N and S;
X$_e$ is selected from D, E and S;
X$_f$ is selected from A and S; and
iv) an amino acid sequence which has at least 91% identity to a sequence defined by iii).

It may be beneficial in some embodiments that said polypeptides exhibit high structural stability, such as resistance to isomerization, to chemical modifications, to changes in physical conditions and to proteolysis, during production and storage, as well as in vivo. Thus, in other embodiments where the IL-6 binding polypeptide as disclosed herein forms part of a three-helix bundle protein domain, the IL-6 binding polypeptide may comprise a binding module (BMod), the amino acid sequence of which is selected from:

(SEQ ID NO: 1564)
v) K-[BM]-QPEQSX$_a$X$_b$LLX$_c$EAKKLX$_d$X$_e$X$_f$Q, wherein
[BM] is an IL-6 binding motif as defined herein, provided that X$_{29}$ is R;
X$_a$ is selected from A and S;
X$_b$ is selected from N and E;
X$_c$ is selected from A, S and C;
X$_d$ is selected from E, N and S;
X$_e$ is selected from D, E and S;
X$_f$ is selected from A and S; and
vi) an amino acid sequence which has at least 91% identity to a sequence defined by v).

As discussed above, polypeptides comprising minor changes as compared to the above amino acid sequences, which do not largely affect the tertiary structure and the function of the polypeptide are also within the scope of the present disclosure. Thus, in some embodiments, sequence iv) and vi) have at least 93%, such as at least 95%, such as at least 97% identity to a sequence defined by iii) and v), respectively.

In one embodiment, X$_a$ in sequence iii) or v) is A.
In one embodiment, X$_a$ in sequence iii) or v) is S.
In one embodiment, X$_b$ in sequence iii) or v) is N.
In one embodiment, X$_b$ in sequence iii) or v) is E.
In one embodiment, X$_c$ in sequence iii) or v) is A.
In one embodiment, X$_c$ in sequence iii) or v) is S.
In one embodiment, X$_c$ in sequence iii) or v) is C.
In one embodiment, X$_d$ in sequence iii) or v) is E.
In one embodiment, X$_d$ in sequence iii) or v) is N.
In one embodiment, X$_d$ in sequence iii) or v) is S.
In one embodiment, X$_e$ in sequence iii) or v) is D.
In one embodiment, X$_e$ in sequence iii) or v) is E.
In one embodiment, X$_e$ in sequence iii) or v) is S.
In one embodiment, X$_d$X$_e$ in sequence iii) or v) is selected from EE, ES, SE, SD and SS.

In one embodiment, X$_d$X$_e$ in sequence iii) or v) is ES.
In one embodiment, X$_d$X$_e$ in sequence iii) or v) is SE.
In one embodiment, X$_d$X$_e$ in sequence iii) or v) is SD.
In one embodiment, X$_f$ in sequence iii) or v) is A.
In one embodiment, X$_f$ in sequence iii) or v) is S.
In one embodiment, in sequence iii) or v), X$_a$ is A; X$_b$ is N; X$_c$ is A and X$_f$ is A.
In one embodiment, in sequence iii) or v), X$_a$ is A; X$_b$ is N; X$_c$ is C and X$_f$ is A.
In one embodiment, in sequence iii) or v), X$_a$ is S; X$_b$ is E; X$_c$ is S and X$_f$ is S.
In one embodiment, in sequence iii) or v), X$_a$ is S; X$_b$ is E; X$_c$ is C and X$_f$ is S.
In one embodiment, in sequence iii) or v), X$_a$ is A; X$_b$ is N; X$_c$ is A; X$_d$X$_e$ is ND and X$_f$ is A.
In one embodiment, in sequence iii) or v), X$_a$ is A; X$_b$ is N; X$_c$ is C; X$_d$X$_e$ is ND and X$_f$ is A.
In one embodiment, in sequence iii) or v), X$_a$ is S; X$_b$ is E; X$_c$ is S; X$_d$X$_e$ is ND and X$_f$ is S.
In one embodiment, in sequence iii) or v), X$_a$ is S; X$_b$ is E; X$_c$ is C; X$_d$X$_e$ is ND and X$_f$ is S.
In one embodiment, in sequence iii) or v), X$_a$ is A; X$_b$ is N; X$_c$ is A; X$_d$X$_e$ is SE and X$_f$ is A.
In one embodiment, in sequence iii) or v), X$_a$ is A; X$_b$ is N; X$_c$ is C; X$_d$X$_e$ is SE and X$_f$ is A.
In one embodiment, in sequence iii) or v), X$_a$ is S; X$_b$ is E; X$_c$ is S; X$_d$X$_e$ is SE and X$_f$ is S.
In one embodiment, in sequence iii) or v), X$_a$ is S; X$_b$ is E; X$_c$ is C; X$_d$X$_e$ is SE and X$_f$ is S.
In one embodiment, in sequence iii) or v), X$_a$ is A; X$_b$ is N; X$_c$ is A; X$_d$X$_e$ is SD and X$_f$ is A.
In one embodiment, in sequence iii) or v), X$_a$ is A; X$_b$ is N; X$_c$ is C; X$_d$X$_e$ is SD and X$_f$ is A.
In one embodiment, in sequence iii) or v), X$_a$ is S; X$_b$ is E; X$_c$ is S; X$_d$X$_e$ is SD and X$_f$ is S.
In one embodiment, in sequence iii) or v), X$_a$ is S; X$_b$ is E; X$_c$ is C; X$_d$X$_e$ is SD and X$_f$ is S.
In one embodiment, in sequence iii) or v), X$_a$ is A; X$_b$ is N; X$_c$ is A; X$_d$X$_e$ is ES and X$_f$ is A.
In one embodiment, in sequence iii) or v), X$_a$ is A; X$_b$ is N; X$_c$ is C; X$_d$X$_e$ is ES and X$_f$ is A.
In one embodiment, in sequence iii) or v), X$_a$ is S; X$_b$ is E; X$_c$ is S; X$_d$X$_e$ is ES and X$_f$ is S.
In one embodiment, in sequence iii) or v), X$_a$ is S; X$_b$ is E; X$_c$ is C; X$_d$X$_e$ is ES and X$_f$ is S.

In yet a further embodiment, sequence iii) corresponds to the sequence from position 7 to position 55 in a sequence selected from the group consisting of SEQ ID NO:1-1551 presented in FIG. 1A-VV. In another embodiment, sequence iii) corresponds to the sequence from position 7 to position 55 in a sequence selected from the group consisting of SEQ ID NO:1-1502. In one embodiment, sequence iii) corresponds to the sequence from position 7 to position 55 in a sequence selected from the group consisting of SEQ ID NO:7, SEQ ID NO:15-89 and SEQ ID NO:151-871. In one embodiment, sequence iii) corresponds to the sequence from position 7 to position 55 in a sequence selected from the group consisting of SEQ ID NO:1-6, SEQ ID NO:8-14, SEQ ID NO:90-150 and SEQ ID NO:872-1502. In one embodiment, sequence iii) corresponds to the sequence from position 7 to position 55 in a sequence selected from the group consisting of SEQ ID NO:1-152 and SEQ ID NO:1503-1515. In one embodiment, sequence iii) corresponds to the sequence from position 7 to position 55 in a sequence selected from the group consisting of SEQ ID NO:1-150 and SEQ ID NO:1503-1515. In one embodiment, sequence iii) corresponds to the sequence from position 7 to position 55 in a sequence selected from the group consisting of SEQ ID NO:1-152. In another embodiment, sequence iii) corresponds to the sequence from position 7 to position 55 in a sequence selected from the group consisting of SEQ ID NO:1-150. In yet another embodiment, sequence iii) corresponds to the sequence from position 7 to position 55 in a sequence selected from the group consisting of SEQ ID NO:7, SEQ ID NO:15-89 and SEQ ID NO:151-152. In one embodiment, sequence iii) corresponds to the sequence from position 7 to position 55 in a sequence selected from the group consisting of SEQ ID NO:1-6, SEQ ID NO:8-14 and SEQ ID NO:90-150. In one embodiment, sequence iii) corresponds to the sequence from position 7 to position 55 in a sequence selected from the group consisting of SEQ ID NO:1-14 and SEQ ID NO:1503-1515. In one embodiment, sequence iii) corresponds to the sequence from position 7 to position 55 in a sequence selected from the group consisting of SEQ ID NO:1-14 and SEQ ID NO:1512. In one embodiment, sequence iii) corresponds to the sequence from position 7 to position 55 in a sequence selected from the group consisting of SEQ ID NO:1-14. In one embodiment, sequence iii) corresponds to the sequence from position 7 to position 55 in a sequence selected from the group consisting of SEQ ID NO:1-5. In one embodiment, sequence iii) corresponds to the sequence from position 7 to position 55 in sequence SEQ ID NO:1512. In specific individual embodiments, sequence iii) corresponds to the sequence from position 7 to position 55 in any one of SEQ ID NO:1-14 individually.

Also, in a further embodiment, there is provided an IL-6 binding polypeptide, which comprises an amino acid sequence selected from:
vii) YA-[BMod]-AP;
wherein [BMod] is an IL-6 binding module as defined above; and
viii) an amino acid sequence which has at least 90% identity to a sequence defined by vii).

Alternatively, there is provided an IL-6 binding polypeptide, which comprises an amino acid sequence selected from:
ix) FN-[BMod]-AP;
wherein [BMod] is an IL-6 binding module as defined above; and
x) an amino acid sequence which has at least 90% identity to a sequence defined by ix).

As discussed above, polypeptides comprising minor changes as compared to the above amino acid sequences, which do not largely affect the tertiary structure and the function of the polypeptide, also fall within the scope of the present disclosure. Thus, in some embodiments, sequence viii) and x) may for example be least 92%, such as at least 94%, such as at least 96%, such as at least 98% identical to a sequence defined by vii) and ix), respectively.

In some embodiments, the IL-6 binding motif may form part of a polypeptide comprising an amino acid sequence selected from

```
                                    (SEQ ID NO: 1565)
ADNNFNK-[BM]-DPSQSANLLSEAKKLNESQAPK;

(SEQ ID NO: 1566)
ADNKFNK-[BM]-DPSQSANLLAEAKKLNDAQAPK;

(SEQ ID NO: 1567)
ADNKFNK-[BM]-DPSVSKEILAEAKKLNDAQAPK;
```

```
                                    (SEQ ID NO: 1568)
ADAQQNNFNK-[BM]-DPSQSTNVLGEAKKLNESQAPK;

(SEQ ID NO: 1569)
AQHDE-[BM]-DPSQSANVLGEAQKLNDSQAPK;

(SEQ ID NO: 1570)
VDNKFNK-[BM]-DPSQSANLLAEAKKLNDAQAPK;

(SEQ ID NO: 1571)
AEAKYAK-[BM]-DPSESSELLSEAKKLNKSQAPK;

(SEQ ID NO: 1572)
VDAKYAK-[BM]-DPSQSSELLAEAKKLNDAQAPK;

(SEQ ID NO: 1573)
VDAKYAK-[BM]-DPSQSSELLAEAKKLNDSQAPK;

(SEQ ID NO: 1574)
AEAKYAK-[BM]-DPSQSSELLSEAKKLNDSQAPK;

(SEQ ID NO: 1575)
AEAKYAK-[BM]-DPSQSSELLSEAKKLSESQAPK;

(SEQ ID NO: 1576)
AEAKYAK-[BM]-QPEQSSELLSEAKKLSESQAPK;

(SEQ ID NO: 1577)
AEAKYAK-[BM]-DPSQSSELLSEAKKLESSQAPK;

(SEQ ID NO: 1578)
AEAKYAK-[BM]-QPEQSSELLSEAKKLESSQAPK;

(SEQ ID NO: 1579)
VDAKYAK-[BM]-DPSQSSELLSEAKKLNDSQAPK;

(SEQ ID NO: 1580)
VDAKYAK-[BM]-DPSQSSELLSEAKKLSESQAPK;

(SEQ ID NO: 1581)
VDAKYAK-[BM]-QPEQSSELLSEAKKLSESQAPK;

(SEQ ID NO: 1582)
VDAKYAK-[BM]-DPSQSSELLSEAKKLESSQAPK;

(SEQ ID NO: 1583)
VDAKYAK-[BM]-QPEQSSELLSEAKKLESSQAPK;

(SEQ ID NO: 1584)
VDAKYAK-[BM]-DPSQSSELLAEAKKLNKAQAPK;
and (SEQ ID NO: 1585)
AEAKYAK-[BM]-DPSQSSELLAEAKKLNKAQAPK;
``` wherein [BM] is an IL-6 binding motif as defined above.

In one embodiment, the IL-6 binding polypeptide comprises an amino acid sequence selected from:

```
                                    (SEQ ID NO: 1586)
xi)  VDAKYAK-[BM]-DPSQSSELLSEAKKLNDSQAPK;
``` wherein [BM] is an IL-6 binding motif as defined above; and
xii) an amino acid sequence which has at least 89% identity to the sequence defined in xi).

In another embodiment, the IL-6 binding polypeptide comprises an amino acid sequence selected from:

```
                                    (SEQ ID NO: 1587)
xiii)  AEAKYAK-[BM]-DPSQSSELLSEAKKLNDSQAPK;
``` wherein [BM] is an IL-6 binding motif as defined above; and
xiv) an amino acid sequence which has at least 89% identity to the sequence defined in xiii).

Again, polypeptides comprising minor changes as compared to the above amino acid sequences, which do not largely affect the tertiary structure and the function of the polypeptide, also fall within the scope of the present disclosure. Thus, in some embodiments, sequence xii) and xiv) may for example be at least 91%, such as at least 93%, such as at least 94%, such as at least 96%, such as at least 98% identical to the sequence defined by xi) and xiii), respectively.

Sequence xi) in such a polypeptide may be selected from the group consisting of SEQ ID NO:1-1551. In another embodiment, sequence xi) is selected from the group consisting of SEQ ID NO:1-1502. In one embodiment, sequence xi) is selected from the group consisting of SEQ ID NO:7, SEQ ID NO:15-89 and SEQ ID NO:151-871. In one embodiment, sequence xi) is selected from the group consisting of SEQ ID NO:1-6, SEQ ID NO:8-14, SEQ ID NO:90-150 and SEQ ID NO:872-1502. In one embodiment, sequence xi) is selected from the group consisting of SEQ ID NO:1-152 and SEQ ID NO:1503-1515. In one embodiment, sequence xi) is selected from the group consisting of SEQ ID NO:1-150 and SEQ ID NO:1503-1515. In one embodiment, sequence xi) is selected from the group consisting of SEQ ID NO:1-152. In another embodiment, sequence xi) is selected from the group consisting of SEQ ID NO:1-150. In yet another embodiment, sequence xi) is selected from the group consisting of SEQ ID NO:7, SEQ ID NO:15-89 and SEQ ID NO:151-152. In one embodiment, sequence xi) is selected from the group consisting of SEQ ID NO:1-6, SEQ ID NO:8-14 and SEQ ID NO:90-150. In one embodiment, sequence xi) is selected from the group consisting of SEQ ID NO:1-14 and SEQ ID NO:1503-1515. In one embodiment, sequence xi) is selected from the group consisting of SEQ ID NO:1-14 and SEQ ID NO:1512. In one embodiment, sequence xi) is selected from the group consisting of SEQ ID NO:1-14. In one embodiment, sequence xi) is selected from the group consisting of SEQ ID NO:1-5. In one embodiment, sequence xi) is SEQ ID NO:1512. In specific individual embodiments, sequence xi) is any one of SEQ ID NO:1-14 individually.

Binding of a polypeptide as defined herein to IL-6 may interfere with canonical cis- and/or with trans-signaling via IL-6 in vivo or in vitro. Thus, in one embodiment, there is provided an IL-6 binding polypeptide as defined herein which is capable of blocking IL-6 dependent signaling via the cis-signaling pathway. In another embodiment, the IL-6 binding polypeptide as defined herein is capable of blocking IL-6 dependent signaling via the trans-signaling pathway. In another embodiment, the IL-6 binding polypeptide as defined herein is capable of blocking IL-6 dependent signaling via both the cis-signaling pathway and the trans-signaling pathway.

The half maximal inhibitory concentration (IC50) is a measure of the effectiveness of a substance in inhibiting a specific biological or biochemical function. This quantitative measure indicates how much of a particular substance is needed to inhibit a given biological process by half, and is commonly used in the art. In one particular embodiment, there is provided an IL-6 binding polypeptide as defined herein capable of blocking IL-6 signaling such that the half maximal inhibitory concentration (IC50) of the blocking is at most $1\times10^{-6}$ M, such as at most $1\times10^{-7}$ M, such as at most $1\times10^{-8}$ M, such as at most $1\times10^{-9}$ M, such as at most $1\times10^{-10}$ M. This blocking may be blocking of either the cis- or the trans-signaling pathway. In one embodiment, the IL-6 binding polypeptide is capable of blocking the interaction of IL-6/IL-6Rα with gp130.

The terms "IL-6 binding" and "binding affinity for IL-6" as used in this specification refer to a property of a polypeptide which may be tested for example by ELISA or the use of surface plasmon resonance (SPR) technology. For example as described in the examples below, IL-6 binding affinity may be tested in an experiment in which samples of the polypeptide are captured on antibody-coated ELISA plates and biotinylated IL-6 is added followed by streptavidin-conjugated HRP. TMB substrate is added and the absorbance at 450 nm is measured using a multi-well plate reader, such as Victor³ (Perkin Elmer). The skilled person may then interpret the results obtained by such experiments to establish at least a qualitative measure of the binding affinity of the polypeptide for IL-6. If a quantitative measure is desired, for example to determine the EC50 value (the half maximal effective concentration) for the interaction, ELISA may also be used. The response of the polypeptide against a dilution series of biotinylated IL-6 is measured using ELISA as described above. The skilled person may then interpret the results obtained by such experiments, and EC50 values may be calculated from the results using for example Graph Pad Prism 5 and non-linear regression.

IL-6 binding affinity may also be tested in an experiment in which IL-6, or a fragment thereof, is immobilized on a sensor chip of a surface plasmon resonance (SPR) instrument, and the sample containing the polypeptide to be tested is passed over the chip. Alternatively, the polypeptide to be tested is immobilized on a sensor chip of the instrument, and a sample containing IL-6, or a fragment thereof, is passed over the chip. The skilled person may then interpret the results obtained by such experiments to establish at least a qualitative measure of the binding affinity of the polypeptide for IL-6. If a quantitative measure is desired, for example to determine a $K_D$ value for the interaction, surface plasmon resonance methods may also be used. Binding values may for example be defined in a Biacore (GE Healthcare) or ProteOn XPR 36 (Bio-Rad) instrument. IL-6 is suitably immobilized on a sensor chip of the instrument, and samples of the polypeptide whose affinity is to be determined are prepared by serial dilution and injected in random order. $K_D$ values may then be calculated from the results using for example the 1:1 Langmuir binding model of the BIAevaluation 4.1 software, or other suitable software, provided by the instrument manufacturer.

Thus, in one embodiment, there is provided an IL-6 binding polypeptide as defined herein, which is capable of binding to IL-6 such that the EC50 value of the interaction is at most $1\times10^{-7}$ M, such as at most $1\times10^{-8}$ M, such as at most $1\times10^{-9}$ M, such as at most $1\times10^{-10}$ M.

In one embodiment, the IL-6 binding polypeptide is capable of binding to IL-6 such that the $K_D$ value of the interaction is at most $1\times10^{-8}$ M, such as at most $1\times10^{-9}$ M, such as at most $1\times10^{-10}$ M.

The skilled person will understand that various modifications and/or additions can be made to an IL-6 binding polypeptide according to any aspect disclosed herein in order to tailor the polypeptide to a specific application without departing from the scope of the present disclosure.

For example, in one embodiment there is provided an IL-6 binding polypeptide as described herein, which polypeptide has been extended by and/or comprises additional amino acids at the C terminus and/or N terminus. Such a polypeptide should be understood as a polypeptide having one or more additional amino acid residues at the very first and/or the very last position in the polypeptide chain. Thus, an IL-6 binding polypeptide may comprise any suitable number of additional amino acid residues, for example at least one additional amino acid residue. Each additional amino acid residue may individually or collectively be added in order to, for example, improve production, purification, stabilization in vivo or in vitro, coupling or detection of the polypeptide. Such additional amino acid residues may comprise one or more amino acid residues added for the purpose of chemical coupling. One example of this is the addition of a cysteine residue. Additional amino acid residues may also provide a "tag" for purification or detection of the polypeptide, such as a $His_6$ tag, a $(HisGlu)_3$ tag ("HEHEHE" tag) (SEQ ID NO:1588) or a "myc" (c-myc) tag or a "FLAG" tag for interaction with antibodies specific to the tag or immobilized metal affinity chromatography (IMAC) in the case of a $His_6$-tag.

The further amino acids as discussed above may be coupled to the IL-6 binding polypeptide by means of chemical conjugation (using known organic chemistry methods) or by any other means, such as expression of the IL-6 binding polypeptide as a fusion protein or joined in any other fashion, either directly or via a linker, for example an amino acid linker.

The further amino acids as discussed above may for example comprise one or more polypeptide domain(s). A further polypeptide domain may provide the IL-6 binding polypeptide with another function, such as for example yet another binding function, an enzymatic function, a toxic function, a fluorescent signaling function or combinations thereof.

A further polypeptide domain may moreover provide another IL-6 binding moiety with the same IL-6 binding function. Thus, in a further embodiment, there is provided an IL-6 binding polypeptide in a multimeric form. Said multimer is understood to comprise at least two IL-6 binding polypeptides as disclosed herein as monomer units, the amino acid sequences of which may be the same or different. Multimeric forms of the polypeptides may comprise a suitable number of domains, each having an IL-6 binding motif, and each forming a monomer within the multimer. These domains may have the same amino acid sequence, but alternatively, they may have different amino acid sequences. In other words, the IL-6 binding polypeptide of the invention may form homo- or heteromultimers, for example homo- or heterodimers. In one embodiment, there is provided an IL-6 binding polypeptide, wherein said monomeric units are covalently coupled together. In another embodiment, said IL-6 binding polypeptide monomer units are expressed as a fusion protein. In one embodiment, there is provided an IL-6 binding polypeptide in dimeric form.

Additionally, "heterogenic" fusion polypeptides or proteins, or conjugates, in which an IL-6 binding polypeptide described herein, or multimer thereof, constitutes a first domain, or first moiety, and the second and further moieties have other functions than binding IL-6, are also contemplated and fall within the ambit of the present disclosure. The second and further moiety/moieties of the fusion polypeptide or conjugate in such a protein suitably also have a desired biological activity.

Thus, in a second aspect of the present disclosure, there is provided a fusion protein or a conjugate, comprising a first moiety consisting of an IL-6 binding polypeptide according to the first aspect, and a second moiety consisting of a polypeptide having a desired biological activity. In another embodiment, said fusion protein or conjugate may additionally comprise further moieties, comprising desired biological activities that can be either the same or different from the biological activity of the second moiety.

Non-limiting examples of a desired biological activity comprise a therapeutic activity, a binding activity and an enzymatic activity. In one embodiment, the second moiety having a desired biological activity is a therapeutically active polypeptide.

Non-limiting examples of therapeutically active polypeptides are biomolecules, such as molecules selected from the group consisting of human endogenous enzymes, hormones, growth factors, chemokines, cytokines and lymphokines.

Non-limiting examples of binding activities are binding activities which increase the in vivo half-life of the fusion protein or conjugate, and binding activities which act to block a biological activity. In one particular embodiment, the binding activity is an albumin binding activity which increases the in vivo half-life of the fusion protein or conjugate. In one embodiment, said albumin binding activity is provided by the albumin binding domain of streptococcal protein G or a derivative thereof.

In one embodiment of this aspect of the present disclosure, there is provided an IL-6 binding polypeptide, fusion protein or conjugate which comprises an additional immune response modifying agent. Non-limiting examples of additional immune response modifying agents include immunosuppressive or immunomodulating agents or other anti-inflammatory agents. For example, an IL-6 binding polypeptide, fusion protein or conjugate as described herein may be used in combination with disease-modifying anti-rheumatic drugs (DMARDs), such as gold salts, azathioprine, methotrexate and leflunomide; calcineurin inhibitors, such as cyclosporin A or FK 506; modulators of lymphocyte recirculation; mTOR inhibitors, such as rapamycin; an ascomycin having immuno-suppressive properties; glucocorticoids; corticosteroids; cyclophosphamide; immunosuppressive monoclonal antibodies; adhesion molecule inhibitors, such as LFA-1 antagonists, ICAM-1 or -3 antagonists, VCAM-4 antagonists or VLA-4 antagonists; anti-TNF agents, such as etanercept or monoclonal antibodies to TNF, for example infliximab, adalimumab, golimumab and certolizumab pegol; blockers of proinflammatory cytokines; IL-1 blockers such as anakinra or IL-1 trap; IL-17 blockers; chemokine blockers; non steroidal anti-inflammatory drugs (NSAIDs) such as aspirin; and anti-infectious agents and other immune response modulating agents. Thus, in one embodiment, said immune response modifying agent is selected from the group consisting of disease-modifying antirheumatic drugs (DMARDs), calcineurin inhibitors, modulators of lymphocyte recirculation, mTOR inhibitors, ascomycin having immuno-suppressive properties, glucocorticoids, corticosteroids, cyclophosphamide, immunosuppressive monoclonal antibodies, adhesion molecule inhibitors, anti-TNF agents, blockers of proinflammatory cytokines, IL-1 blockers, IL-17 blockers, chemokine blockers, non steroidal anti-inflammatory drugs (NSAIDs) and combinations thereof.

As the skilled person understands, the IL-6 binding polypeptide according to the first aspect may be useful in a fusion protein or as a conjugate partner to any other moiety. Therefore, the above lists of therapeutically active polypeptides and immune response modifying agents should not be construed as limiting in any way.

The skilled person is aware that the construction of a fusion protein often involves the use of linkers between the functional moieties to be fused, and there are different kinds of linkers with different properties, such as flexible amino acid linkers, rigid amino acid linkers and cleavable amino acid linkers. Linkers have been used to for example increase stability or improve folding of fusion proteins, to increase expression, improve biological activity, enable targeting and alter pharmacokinetics of fusion proteins. Thus, in one embodiment, a fusion protein as disclosed herein further comprises at least one linker, such as at least one linker selected from flexible amino acid linkers, rigid amino acid linkers and cleavable amino acid linkers.

Flexible linkers are often used in the art when the joined domains require a certain degree of movement or interaction, and may be particularly useful in some embodiments. Such linkers are generally composed of small, non-polar (for example G) or polar (for example S or T) amino acids. Some flexible linkers primarily consist of stretches of G and S residues, for example $(GGGGS)_p$. Adjusting the copy number "p" allows for optimization of linker in order to achieve appropriate separation between the functional moieties or to maintain necessary inter-moiety interaction. Apart from G and S linkers, other flexible linkers are known in the art, such as G and S linkers containing additional amino acid residues, such as T and A, to maintain flexibility, as well as polar amino acid residues to improve solubility. Examples of flexible linkers that are contemplated for use herein also include KESGSVSSEQLAQFRSLD (SEQ ID NO:1590), EGKSSGSGSEKST (SEQ ID NO:1591) and GSAG-SAAGSGEF (SEQ ID NO:1592).

Thus in one embodiment, said linker is a flexible linker comprising glycine (G), serine (S) and/or threonine (T) residues. In one embodiment, said linker has a general formula selected from $(G_nS_m)_p$ and $(S_mG_n)_p$, wherein, independently, n=1-7, m=0-7, n+m 8 and p=1-7. In one embodiment, n=1-5. In one embodiment, m=0-5. In one embodiment, p=1-5. In a more specific embodiment, n=4, m=1 and p=1-4. In an even more specific embodiment, said linker is (GGGGS) (SEQ ID NO:1589)$_3$. In another specific embodiment, said linker is GGGGS (SEQ ID NO:1589). In another specific embodiment, said linker is VDGS (SEQ ID NO:1593). In another specific embodiment, said linker is ASGS (SEQ ID NO:1594).

The above aspects furthermore encompass polypeptides in which the IL-6 binding polypeptide according to the first aspect, or the IL-6 binding polypeptide as comprised in a fusion protein or conjugate according to the second aspect, further comprises a label, such as a label selected from the group consisting of fluorescent dyes and metals, chromophoric dyes, chemiluminescent compounds and bioluminescent proteins, enzymes, radionuclides and radioactive particles. Such labels may for example be used for detection of the polypeptide.

For example, in embodiments where the labeled IL-6 binding polypeptide comprises an IL-6 binding polypeptide according to the first aspect of the disclosure and a label, the labeled polypeptide may for example be used for indirect labeling of IL-6 expressing cells, such as cells of inflammation associated cancers.

In other embodiments, the labeled IL-6 binding polypeptide is present as a moiety in a fusion protein or conjugate also comprising a second moiety having a desired biological activity. The label may in some instances be coupled only to the IL-6 binding polypeptide, and in some instances both to the IL-6 binding polypeptide and to the second or further moiety of the conjugate or fusion protein. Furthermore, it is also possible that the label may be coupled to a second or further moiety only and not the IL-6 binding moiety. Hence, in yet another embodiment there is provided an IL-6 binding polypeptide comprising a second and optionally a further moiety, wherein said label is coupled to said second or further moiety only.

In embodiments where the IL-6 binding polypeptide, fusion protein or conjugate is radiolabeled, such a radiolabeled polypeptide may comprise a radionuclide. A majority of radionuclides have a metallic nature and metals are typically incapable of forming stable covalent bonds with elements presented in proteins and peptides. For this reason, labeling of proteins and peptides with radioactive metals is performed with the use of chelators, i.e. multidentate ligands, which form non-covalent compounds, called chelates, with the metal ions. In an embodiment of the IL-6 binding polypeptide, fusion protein or conjugate, the incorporation of a radionuclide is enabled through the provision of a chelating environment, through which the radionuclide may be coordinated, chelated or complexed to the polypeptide.

One example of a chelator is the polyaminopolycarboxylate type of chelator. Two classes of such polyaminopolycarboxylate chelators can be distinguished: macrocyclic and acyclic chelators.

In one embodiment, the IL-6 binding polypeptide, fusion protein or conjugate comprises a chelating environment provided by a polyaminopolycarboxylate chelator conjugated to the IL-6 binding polypeptide via a thiol group of a cysteine residue or an epsilon amine group of a lysine residue.

The most commonly used macrocyclic chelators for radioisotopes of indium, gallium, yttrium, bismuth, radioactinides and radiolanthanides are different derivatives of DOTA (1,4,7,10-tetraazacyclododecane-1,4,7,10-tetraacetic acid). In one embodiment, a chelating environment of the IL-6 binding polypeptide, fusion protein or conjugate is provided by DOTA or a derivative thereof. More specifically, in one embodiment, the chelating polypeptides encompassed by the present disclosure are obtained by reacting the DOTA derivative 1,4,7,10-tetraazacyclododecane-1,4,7-trisacetic acid-10-maleimidoethylacetamide (maleimidomonoamide-DOTA) with said polypeptide.

Additionally, 1,4,7-triazacyclononane-1,4,7-triacetic acid (NOTA) and derivatives thereof may be used as chelators. Hence, in one embodiment, there is provided a IL-6 binding polypeptide, fusion protein or conjugate, wherein the polyaminopolycarboxylate chelator is 1,4,7-triazacyclononane-1,4,7-triacetic acid or a derivative thereof.

The most commonly used acyclic polyaminopolycarboxylate chelators are different derivatives of DTPA (diethylenetriamine-pentaacetic acid).

Hence, polypeptides having a chelating environment provided by diethylenetriaminepentaacetic acid or derivatives thereof are also encompassed by the present disclosure.

In further aspects of the present disclosure, there is provided a polynucleotide encoding an IL-6 binding polypeptide or a fusion protein as described herein; an expression vector comprising said polynucleotide; and a host cell comprising said expression vector.

Also encompassed by this disclosure is a method of producing a polypeptide or fusion protein as described above, comprising culturing said host cell under conditions permissive of expression of said polypeptide from its expression vector, and isolating the polypeptide.

The IL-6 binding polypeptide of the present disclosure may alternatively be produced by non-biological peptide synthesis using amino acids and/or amino acid derivatives having protected reactive side-chains, the non-biological peptide synthesis comprising step-wise coupling of the amino acids and/or the amino acid derivatives to form a polypeptide according to the first aspect having protected reactive side-chains, removal of the protecting groups from the reactive sidechains of the polypeptide, and folding of the polypeptide in aqueous solution.

It should be understood that the IL-6 binding polypeptide according to the present disclosure may be useful as a therapeutic, diagnostic or prognostic agent in its own right or as a means for targeting other therapeutic or diagnostic agents, with e.g. direct or indirect effects on IL-6. A direct therapeutic effect may for example be accomplished by inhibiting IL-6 signaling.

The small size and robustness of the molecules of the present disclosure confer several advantages over conventional monoclonal antibody based therapies. Such advantages include modes of administration, such as alternative routes of administration, administration at higher doses than antibodies and absence of Fc-mediated side effects. The small size combined with the potential for very high solubility and stability of the polypeptides disclosed herein allows for extreme molar amounts of drug in a small volume, for example for subcutaneous injections. For systemic administration, this suggests outpatient "home use" treatment using convenient, small prefilled syringes or auto-injectors, with low volume and well tolerated administration of doses. In addition, the capacity for high molar concentrations in drug preparations in combination with the ability to retain functional stability in diverse formulations opens up for topical (for example skin or lung) or oral administration routes. Non-limiting examples of indications where alternative administration routes could be especially relevant in IL-6 mediated disease include asthma and psoriasis.

In another aspect, there is provided a composition comprising an IL-6 binding polypeptide, fusion protein or conjugate as described herein and at least one pharmaceutically acceptable excipient or carrier. In one embodiment, said composition further comprises at least one additional active agent, such as at least two additional active agents, such as at least three additional active agents. Non-limiting examples of additional active agents that may prove useful in such combination are immune response modifying agents and anti-cancer agents as described herein.

Non-limiting examples of anti-cancer agents include agents selected from the group consisting of auristatin, anthracycline, calicheamycin, combretastatin, doxorubicin, duocarmycin, the CC-1065 anti-tumor antibiotic, ecteinsascidin, geldanamycin, maytansinoid, methotrexate, mycotoxin, taxol, ricin, bouganin, gelonin, pseudomonas exotoxin 38 (PE38), diphtheria toxin (DT), and their analogues, and derivates thereof and combinations thereof. A skilled person would appreciate that the non-limiting examples of cytotoxic agents include all possible variant of said agents, for example the agent auristatin includes for example auristatin E, auristatin F, auristatin PE, and derivates thereof.

The skilled person will appreciate that said IL-6 binding polypeptide, fusion protein or conjugate or a composition comprising an anti-IL-6 binding polypeptide, fusion protein or conjugate as described herein may be administered to a subject using standard administration techniques, including oral, topical, intravenous, intraperitoneal, subcutaneous, pulmonary, transdermal, intramuscular, intranasal, buccal, sublingual or suppository administration. Thus, in one embodiment, there is provided an IL-6 binding polypeptide, fusion protein or conjugate or a composition as described herein for oral, topical, intravenous, intraperitoneal, subcutaneous, pulmonary, transdermal, intramuscular, intranasal, buccal, sublingual or suppository administration.

IL-6 may also serve as a valuable marker for diagnosis and prognosis of certain cancers, such as inflammation associated-cancers, for example lung cancer, breast cancer and colon cancer. For example, IL-6 has been linked to the prognosis and poor survival in patients suffering from colorectal cancer (Ky et al., Jpn J Clin Oncol. 2010 June, 40(6):580-7).

Hence, in another aspect of the present disclosure, there is provided an IL-6 binding polypeptide, fusion protein, conjugate or composition as described herein for use as a medicament, a prognostic agent or a diagnostic agent. In one embodiment, said IL-6 binding polypeptide is provided for use as a medicament.

In one embodiment, there is provided an IL-6 binding polypeptide, fusion protein or conjugate or composition as described herein, for use as a medicament to modulate IL-6 function in vivo. As used herein, the term "modulate" refers to changing the activity, such as rendering IL-6 function hypomorph, partially inhibiting or fully inhibiting IL-6 function.

Non-limiting examples of IL-6 related disorders, wherein the IL-6 binding polypeptides may be useful for treatment, prognosis and/or diagnosis, include inflammatory disease, autoimmune disease, infectious disease, cancer, diabetes, neurological disease and depression, such as rheumatoid arthritis (RA), juvenile RA, juvenile idiopathic arthritis or systemic juvenile idiopathic arthritis, vasculitis, psoriatic arthritis, psoriasis, ankylosing spondylitis, chronic inflammatory bowel disease such as Crohn's disease and ulcerative colitis; Grave's disease, Behcet's disease, uveitis, giant cell arteritis, multiple sclerosis (MS), systemic sclerosis, systemic lupus erythematosus (SLE), polymyositis, polymyalgia rheumatic, asthma, chronic obstructive pulmonary disease (COPD), relapsing polychondritis, pancreatitis, peritonitis, nephritis, Kawasaki's disease, Sjögren's syndrome, adult Still's disease, colitis associated cancer, renal cancer, kidney cancer, prostate cancer, malignant lymphoma, multiple myeloma, Castleman's disease, breast cancer, lung cancer, Alzheimer's disease, HIV, diabetes, sepsis, cachexia, myelodysplastic syndrome (MDS), liver cirrhosis, graft versus host disease, myocardial infarction, endometriosis and osteoporosis. Non-limiting examples of IL-6 related cancers include lung cancer, breast cancer and colon cancer (Schafer and Brugge, J Clin Invest. (2007) 117(12): 3660-3663; Nagasaki et al., British Journal of Cancer (2014) 110, 469-478).

Thus, in one embodiment, there is provided an IL-6 binding polypeptide, fusion protein, conjugate or composition for use in the treatment, prognosis or diagnosis of an IL-6 related disorder, such as a disorder selected from the group consisting of inflammatory disease, autoimmune disease, infectious disease, cancer, diabetes, neurological disease and depression. In one embodiment, said IL-6 related disorder is selected from the group consisting of inflammatory diseases and autoimmune diseases. In one embodiment, said IL-6 related disorder is selected from the group consisting of rheumatoid arthritis (RA), juvenile RA, juvenile idiopathic arthritis or systemic juvenile idiopathic arthritis, vasculitis, psoriatic arthritis, psoriasis, ankylosing spondylitis, chronic inflammatory bowel disease such as Crohn's disease and ulcerative colitis; Grave's disease, Behcet's disease, uveitis, giant cell arteritis, multiple sclerosis (MS), systemic sclerosis, systemic lupus erythematosus (SLE), polymyositis, polymyalgia rheumatic, asthma, chronic obstructive pulmonary disease (COPD), relapsing polychondritis, pancreatitis, peritonitis, nephritis, Kawasaki's disease, Sjögren's syndrome and adult Still's disease. In another embodiment, said IL-6 related disorder is cancer, such as a cancer selected from the group consisting of colitis associated cancer, renal cancer, kidney cancer, prostate cancer, malignant lymphoma, multiple myeloma, Castleman's disease, breast cancer and lung cancer. In another embodiment, said IL-6 related disorder is selected from Alzheimer's disease, HIV, diabetes, sepsis, cachexia, myelodysplastic syndrome (MDS), liver cirrhosis, graft versus host disease, myocardial infarction, endometriosis and osteoporosis.

In a related aspect, there is provided a method of treatment of an IL-6 related disorder, comprising administering to a subject in need thereof an effective amount of an IL-6 binding polypeptide, fusion protein, conjugate or composition as described herein. In a more specific embodiment of said method, the IL-6 binding polypeptide, fusion protein, conjugate or composition as described herein modulates IL-6 function in vivo.

In one embodiment, said IL-6 related disorder is selected from the group consisting of inflammatory diseases, autoimmune diseases, infectious disease, cancer, diabetes, neurological disease and depression, such as the group consisting of inflammatory diseases and autoimmune diseases. In one particular embodiment of said aspect, the IL-6 related disorder is selected from the group consisting of rheumatoid arthritis (RA), juvenile RA, juvenile idiopathic arthritis or systemic juvenile idiopathic arthritis, vasculitis, psoriatic arthritis, psoriasis, ankylosing spondylitis, chronic inflammatory bowel disease such as Crohn's disease and ulcerative colitis; Grave's disease, Behcet's disease, uveitis, giant cell arteritis, multiple sclerosis (MS), systemic sclerosis, systemic lupus erythematosus (SLE), polymyositis, polymyalgia rheumatic, asthma, chronic obstructive pulmonary disease (COPD), relapsing polychondritis, pancreatitis, peritonitis, nephritis, Kawasaki's disease, Sjögren's syndrome and adult Still's disease. In another embodiment, said IL-6 related disorder is cancer, such as a cancer selected from the group consisting of colitis associated cancer, renal cancer, kidney cancer, prostate cancer, malignant lymphoma, multiple myeloma, Castleman's disease, breast cancer and lung cancer. In another embodiment, said IL-6 related disorder is selected from the group consisting of Alzheimer's disease, HIV, diabetes, sepsis, cachexia, myelodysplastic syndrome (MDS), liver cirrhosis, graft versus host disease, myocardial infarction, endometriosis and osteoporosis.

It may be beneficial to administer a therapeutically effective amount of an IL-6 binding polypeptide, fusion protein or conjugate or composition as described herein and at least one second drug substance, such as an immune response modulating agent as described above or an anti-cancer agent.

As used herein, the term "co-administration" encompasses both concomitant and sequential administration. Thus, in one embodiment there is provided a method as defined above further comprising co-administration of an immune response modulating agent as described above. In another embodiment there is provided a method as defined above further comprising co-administration of an anti-cancer agent as described above.

In another aspect of the present disclosure, there is provided a method of detecting IL-6, comprising providing a sample suspected to contain IL-6, contacting said sample with an IL-6 binding polypeptide, fusion protein, conjugate or a composition as described herein, and detecting the binding of the IL-6 binding polypeptide, fusion protein, conjugate or composition to indicate the presence of IL-6 in the sample. In one embodiment, said method further comprises an intermediate washing step for removing non-bound polypeptide, fusion protein, conjugate or composition, after contacting the sample.

In one embodiment, said method is a diagnostic or prognostic method for determining the presence of IL-6 in a subject, the method comprising the steps:
  contacting the subject, or a sample isolated from the subject, with an IL-6 binding polypeptide, fusion protein, conjugate or a composition as described herein, and
  obtaining a value corresponding to the amount of the IL-6 binding polypeptide, fusion protein, conjugate or composition that has bound in said subject or to said sample.

In one embodiment, said method further comprises an intermediate washing step for removing non-bound polypeptide, fusion protein, conjugate or composition, after contacting the subject or sample and before obtaining a value.

In one embodiment, said method further comprises a step of comparing said value to a reference. Said reference may be by a numerical value, a threshold or a visual indicator, for example based on a color reaction. The skilled person will appreciate that different ways of comparison to a reference are known in the art and may be suitable for use.

In one embodiment of such a method, said subject is a mammalian subject, such as a human subject.

In one embodiment, said method is performed in vivo. In another embodiment, said method is performed in vitro.

While the invention has been described with reference to various exemplary aspects and embodiments, it will be understood by those skilled in the art that various changes may be made and equivalents may be substituted for elements thereof without departing from the scope of the invention. In addition, many modifications may be made to adapt a particular situation or molecule to the teachings of the invention without departing from the essential scope thereof. Therefore, it is intended that the invention not be limited to any particular embodiment contemplated, but that the invention will include all embodiments falling within the scope of the appended claims.

BRIEF DESCRIPTION OF THE FIGURES

FIG. 1A-VV is a listing of amino acid sequences of examples of IL-6 binding polypeptides of the present disclosure (SEQ ID NO:1-1551), control polypeptides (SEQ ID NO:1552-1553), the albumin binding domain (ABD) variant PP013 (SEQ ID NO:1554) as well as the amino acid sequences of human IL-6 (SEQ ID NO:1555) and murine IL-6 (SEQ ID NO:1556) used for selection, screening and/or characterization for illustration of the invention. In the IL-6 binding polypeptides of the present disclosure, the deduced IL-6 binding motifs (BM) extend from position 8 to position 36 in each sequence. The amino acid sequences of the 49 amino acid residues long polypeptides predicted to constitute the complete three-helix bundle within each of these Z variants extend from position 7 to position 55 (referred herein to as BMod).

EXAMPLES

Summary

Figure 2:
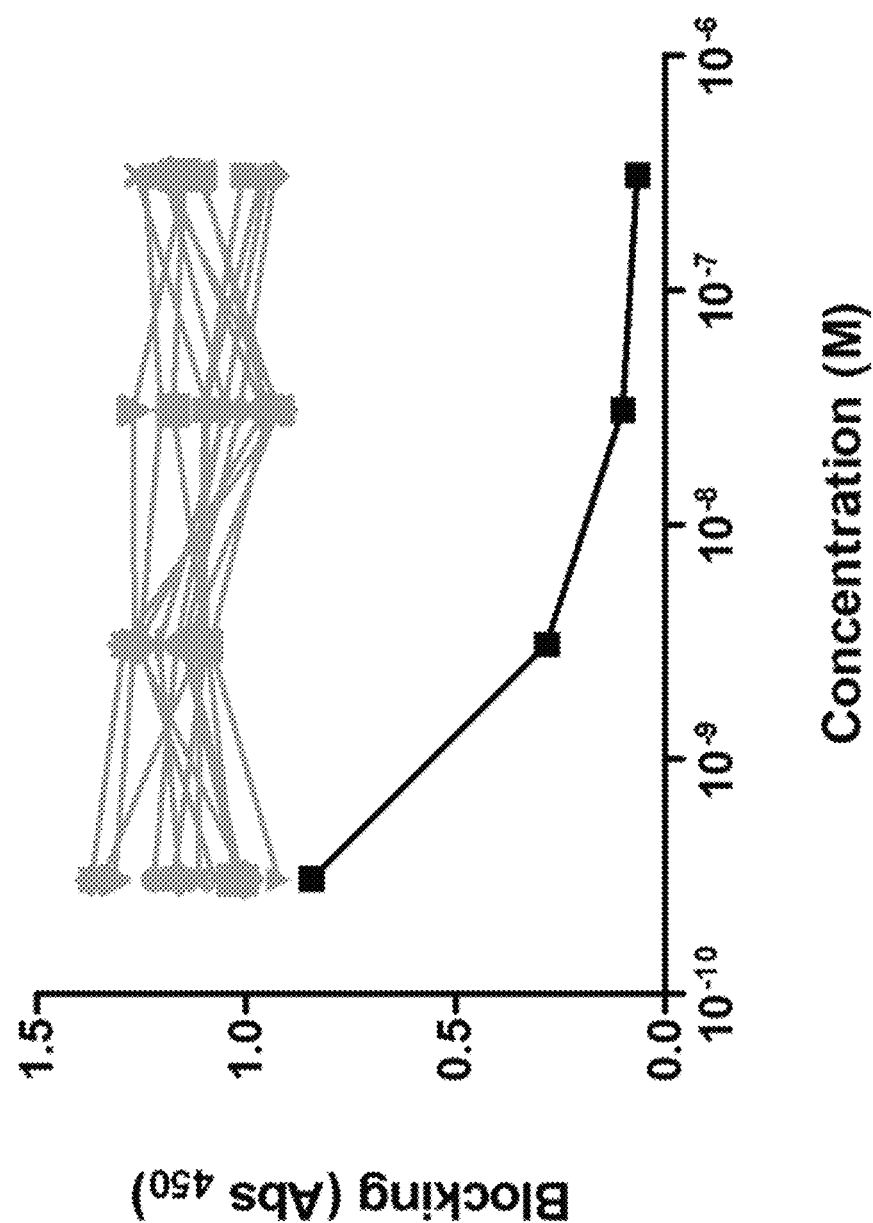
FIG. 2 shows the result of blocking of the interaction between hIL-6 and hIL-6Rα, assayed as described in Example 2. In contrast to the hIL-6Rα binding antibody tocilizumab (black), which was included for comparison, the tested IL-6 binding Z variants (gray) did not interfere with the binding of hIL-6 to its receptor hIL-6Rα.

The following Examples disclose the development of novel Z variant molecules targeting interleukin 6 (IL-6). The Z variants were obtained using phage display technology. The genes encoding IL-6 binding polypeptides described herein were sequenced, and the corresponding amino acid sequences are listed in FIG. 1A-VV and denoted by the identifiers SEQ ID NO:1-1551.

Example 1

Selection and ELISA Screening of IL-6 Binding Z Variants

In this Example, human (hIL-6) and murine IL-6 (mIL-6) were used as target proteins in phage display selections using a phage library of Z variants. The DNA of selected clones was sequenced and the clones were produced in *E. coli* periplasmic fractions and assayed against IL-6 in ELISA (enzyme-linked immunosorbent assay).

Materials and Methods

Biotinylation of the Target Proteins Human and Murine IL-6:

hIL-6 and mIL-6 (Peprotech, cat. no. 200-06 and 216-16, respectively) were biotinylated using No-Weigh EZ-Link Sulfo-NHS-LC-Biotin (Thermo Scientific, cat. no. 21327) at a 12× molar excess according to the manufacturer's recommendations. The reactions were performed at room temperature (RT) for 30 min. Next, buffer exchange to phosphate buffered saline (PBS, 10 mM phosphate, 137 mM NaCl, 2.68 mM KCl, pH 7.4) was performed using Slide-a-lyzer dialysis cassettes (Thermo Scientific, cat. no. 66333, 3,500 MWCO) according to the manufacturer's instructions.

Phage Display Selection of IL-6 Binding Z Variants:

A library of random variants of protein Z displayed on bacteriophage, constructed in phagemid pAY02592 essentially as described in Grönwall et al. (2007) J Biotechnol, 128:162-183, was used to select IL-6 binding Z variants. In this library, an albumin binding domain (abbreviated ABD and corresponding to GA3 of protein G from *Streptococcus* strain G148) was used as fusion partner to the Z variants. The library is denoted Zlib006Naive.II and has a size of 1.5×10^10 library members (Z variants). *E. coli* RRIΔM15 cells (Ruther et al., (1982) Nucleic Acids Res 10:5765-5772) from a glycerol stock containing the phagemid library Zlib006Naive.II were inoculated in 20 l of a defined proline free medium [7 g/l dipotassium hydrogenphosphate, 1 g/l trisodium citrate dihydrate, 0.02 g/l uracil, 6.7 g/l YNB (Difco™ Yeast Nitrogen Base w/o amino acids, Becton Dickinson), 5.5 g/l glucose monohydrate, 0.3 g/l L-alanine, 0.24 g/l L-arginine monohydrochloride, 0.11 g/l L-asparagine monohydrate, 0.1 g/l L-cysteine, 0.3 g/l L-glutamic acid, 0.1 g/l L-glutamine, 0.2 g/l glycine, 0.05 g/l L-histidine, 0.1 g/l L-isoleucine, 0.1 g/l L-leucine, 0.25 g/l L-lysine monohydrochloride, 0.1 g/l L-methionine, 0.2 g/l L-phenylalanine, 0.3 g/l L-serine, 0.2 g/l L-threonine, 0.1 g/l L-tryptophane, 0.05 g/l L-tyrosine, 0.1 g/l L-valine], supplemented with 100 µg/ml ampicillin. The cultivations were grown at 37° C. in a fermenter (Belach Bioteknik, BR20). When the cells reached an optical density at 600 nm ($OD_{600}$) of 0.75, approximately 2.6 l of the cultivation was infected using a 10× molar excess of M13K07 helper phage (New England Biolabs, cat. no. N0315S). The cells were incubated for 30 min, whereupon the fermenter was filled up to 20 l with TSB-YE (Tryptic Soy Broth-Yeast Extract; 30 g/l TSB, 5 g/l yeast extract) supplemented with 100 µM isopropyl-β-D-1-thiogalactopyranoside (IPTG) for induction of expression and with 25 µg/ml kanamycin and 12.5 µg/ml carbenicillin. Cells were grown at 30° C. for 22 h and the cells in the cultivation were pelleted by centrifugation at 15,900 g. Phage particles were precipitated from the supernatant twice in PEG/NaCl (polyethylene glycol/sodium chloride), filtered and dissolved in PBS and glycerol as described in Grönwall et al., supra. Phage stocks were stored at −80° C. before use.

Selection procedure and phage stock preparation were performed essentially as described for selection against another biotinylated target in WO2009/077175. In order to reduce the amount of background binders, pre-selection was performed by incubation of phage stock with SA-beads for 30 min at RT. All tubes and beads used in the selection were pre-blocked with PBS supplemented with 5% BSA. Selection was performed in PBS supplemented with 3% BSA and 0.1% Tween20 during 2 h at RT, followed by capture of target-phage complexes on Dynabeads® M-280 Streptavidin (SA-beads, Invitrogen, cat. no. 11206D) using 1 mg beads per 1.6 µg biotinylated hIL-6 or mIL-6. E. coli strain XL1-Blue (Agilent technologies, cat. no. 200268) was used for phage amplification.

Selections against biotinylated hIL-6 and mIL-6 were performed in four cycles divided in four different final tracks: track (1) in cycle 1 was divided either in the second cycle or the fourth cycle, resulting in totally three tracks (1-1 to 1-3) in cycle 2, three tracks (1-1-1 to 1-3-1) in cycle 3 and four tracks (1-1-1-1 to 1-3-1-2) in cycle 4. After washes, bound phage were eluted from the selection tracks using 500 µl 0.1 M glycine-HCl, pH 2.2, followed by immediate neutralization with 50 µl 1 M Tris-HCl, pH 8.0, and 450 µl PBS. An overview of the selection strategy and parameters used, describing the differences in the selection tracks in terms of lowered target concentration and increased number of washes, is shown in Table 2.

TABLE 2

Overview of the strategy for primary selection

| Cycle | Selection track | Phage stock from library or selection track | Target | Target concentration (nM) | Number of washes |
|---|---|---|---|---|---|
| 1 | 1 | Zlib006Naive.II | hIL-6 | 100 | 2 |
| 2 | 1-1 | 1 | hIL-6 | 50 | 5 |
| 2 | 1-2 | 1 | hIL-6 | 10 | 5 |
| 2 | 1-3 | 1 | mIL-6 | 100 | 4 |
| 3 | 1-1-1 | 1-1 | hIL-6 | 25 | 6 |
| 3 | 1-2-1 | 1-2 | hIL-6 | 2 | 8 |
| 3 | 1-3-1 | 1-3 | hIL-6 | 25 | 6 |
| 4 | 1-1-1-1 | 1-1-1 | hIL-6 | 10 | 8 |
| 4 | 1-2-1-1 | 1-2-1 | hIL-6 | 0.5 | 12 |
| 4 | 1-3-1-1 | 1-3-1 | mIL-6 | 10 | 8 |
| 4 | 1-3-1-2 | 1-3-1 | hIL-6 | 0.5 | 12 |

Sequencing:

PCR fragments were amplified from single colonies using a standard PCR program and the primers AFFI-21 (5'-tgcttccggctcgtatgttgtgtg; SEQ ID NO:1557) and AFFI-22 (5'-cggaaccagagccaccaccgg; SEQ ID NO:1558). Sequencing of amplified fragments was performed using the biotinylated oligonucleotide AFFI-72 (5'-biotin-cggaaccagagccaccac-cgg; SEQ ID NO:1559) and a BigDye® Terminator v3.1 Cycle Sequencing Kit (Applied Biosystems), used in accordance with the manufacturer's recommendations. The sequencing reactions were purified by binding to magnetic streptavidin coated beads (Detach Streptavidin Beads, Nordiag, cat. no. 2012-01) using a Magnatrix 8000 (Magnetic Biosolution) instrument and analyzed on an ABI PRISM® 3130xl Genetic Analyzer (PE Applied Biosystems).

Production of Z Variants for ELISA:

Sequenced Z variants were produced by inoculating single colonies from the selections in 1 ml TSB-YE medium supplemented with 100 µg/ml ampicillin and 0.1 mM IPTG in deep-well plates (Nunc, cat. no. 278752). The plates were incubated for 24 h at 37° C. Cells were pelleted by centrifugation, re-suspended in 200 µl PBST 0.05% (PBS supplemented with 0.05% Tween-20), frozen at −80° C. and thawed in a water bath to release the periplasmic fraction of the cells. The freeze-thawing procedure was repeated five times. The samples were diluted with PBST 0.05% to a total of 800 µl and cells were pelleted by centrifugation. The supernatant of the periplasmic extract contained the Z variants as fusions to ABD, expressed as AQHDEALE-[Z #####]-VDYV4ABDFYVPG (Grönwall et al., supra). Z ##### refers to individual, 58 amino acid residue Z variants.

ELISA Analysis of Z Variants:

The binding of Z variants to IL-6 was analyzed in an ELISA assay. Half-area 96-well ELISA plates (Costar, cat. no. 3690) were coated at 4° C. overnight with 2 µg/ml of an anti-ABD goat antibody (produced in-house) diluted in coating buffer (50 mM sodium carbonate, pH 9.6; Sigma, cat. no. C3041). The antibody solution was poured off and the wells were blocked with 100 µl of PBSC (PBS supplemented with 0.5% casein; Sigma, cat. no. C8654) for 1.5 h at RT. The blocking solution was discarded and 50 µl periplasmic solution was added to the wells and incubated for 1.5 h at RT under slow shaking. The supernatants were poured off and the wells were washed 4 times with PBST 0.05%. Next, 50 µl of biotinylated hIL-6 at a concentration of 7.7 nM in PBSC was added to each well. The plates were incubated for 1.5 h at RT followed by washes as described above. Streptavidin conjugated HRP (Thermo Scientific, cat. no. N100) was diluted 1:30 000 in PBSC and added to the wells followed by 45 min incubation. After washing as described above, 50 µl ImmunoPure TMB substrate (Thermo Scientific, cat. no. 34021) was added to the wells and the plates were treated according to the manufacturer's recommendations. A Z variant binding a specific irrelevant protein was used as a positive control by assaying against that specific irrelevant protein, and as a negative control by assaying against hIL-6. As blank control, PBST 0.05% was added instead of the periplasmic sample. Absorbance was measured at 450 nm using a multi-well plate reader (Victor$^3$, Perkin Elmer).

Results

Phage Display Selection of IL-6 Binding Z Variants:

Individual clones were prepared after four cycles of phage display selections against biotinylated hIL-6 and mIL-6.

Sequencing:

Sequencing was performed for clones picked at random from selection round four. Each Z variant was given a unique identification number #####, and individual variants are referred to as Z #####. The amino acid sequences of 58 residues long Z variants are listed in FIG. 1A-VV and in the sequence listing as SEQ ID NO:1503-1551. The deduced IL-6 binding motifs (BM) extend from position 8 to position 36 in each sequence. The amino acid sequences of the 49 amino acid residues long polypeptides predicted to constitute the complete three-helix bundle within each of these Z variants (BMod) extend from position 7 to position 55.

ELISA Analysis of Z Variants:

The clones obtained after four cycles of selection were produced in 96-well plates and screened for hIL-6 binding activity in ELISA. All clones giving a response with signals corresponding to at least 3× the negative control were considered as positive IL-6 binders. The control molecule specific for an irrelevant protein gave a positive signal for the specific protein, whereas no signal was obtained against hIL-6.

Example 2

Production and In Vitro Characterization of IL-6 Binding Z Variants

In this Example, a subset of Z variants were subcloned, produced and functionally assessed in competition ELISAs and cell assays. Two different ELISA assays were applied to investigate if the IL-6 binding Z variants were able to block the specific interaction between IL-6 and IL-6Rα or between IL-6 and the gp130 receptor, respectively. The potency of the Z variant polypeptides was assessed using two different cell assays, mimicking the classical cis-signaling pathway and trans-signaling pathway, respectively. Finally, circular dichroism (CD) spectroscopy was performed for a subset of the Z variants in order to investigate their secondary structure and determine their melting temperatures, Tm.

Materials and Methods

Subcloning of Z Variants:

The DNA of 13 IL-6 binding Z variants, Z06777 (SEQ ID NO:1503), Z06779 (SEQ ID NO:1504), Z06789 (SEQ ID NO:1505), Z06791 (SEQ ID NO:1506), Z06792 (SEQ ID NO:1507), Z06799 (SEQ ID NO:1508), Z06802 (SEQ ID NO:1509), Z06805 (SEQ ID NO:1510), Z06809 (SEQ ID NO:1511), Z06814 (SEQ ID NO:1512), Z06829 (SEQ ID NO:1513), Z06834 (SEQ ID NO:1514), Z06844 (SEQ ID NO:1515) was amplified from the library vector pAY02592. A subcloning strategy for construction of monomeric Z variant molecules with an N-terminal $His_6$ tag was applied using standard molecular biology techniques (essentially as described in WO2009/077175 for Z variants binding another target). The Z gene fragments were subcloned into the expression vector pAY01448 resulting in the encoded sequence MGSSHHHHHHLQ-[Z #####]-VD.

A subset of five IL-6 binding Z variants, Z06789, Z06799, Z06809, Z06814 and Z06829, and two control Z variants binding an irrelevant target, Z03638 (SEQ ID NO:1552) and Z04726 (SEQ ID NO:1553), were subcloned in fusion with the ABD variant PP013 (SEQ ID NO:1554). The constructs encoded by the expression vectors were MGSSLQ-[Z #####]-VDGS-PP013.

Cultivation and Purification:

*E. coli* BL21(DE3) cells (Novagen) were transformed with plasmids containing the gene fragment of each respective IL-6 binding Z variant and cultivated at 37° C. in 800 or 1000 ml of TSB-YE medium supplemented with 50 µg/ml kanamycin. In order to induce protein expression, IPTG was added to a final concentration of 0.2 mM at $OD_{600}$=2 and the cultivation was incubated at 37° C. for another 5 h. The cells were harvested by centrifugation.

Purification of IL-6 Binding Z Variants with a $His_6$-Tag:

Protein purification was performed under either native or denatured conditions.

The purification under native conditions was performed as follows:

Approximately 2-5 g of each cell pellet was resuspended in 10 ml PBS. After cell disruption by sonication, cell debris was removed by centrifugation and each supernatant was applied on 2 ml Talon cobolt columns (Clontech, cat. no. 635504) equilibrated with 20 ml wash buffer (46.6 mM $Na_2HPO_4$, 3.4 mM $NaH_2PO_4$, and 300 mM NaCl, pH 7.0). Contaminants were removed by washing with wash buffer, and the IL-6 binding Z variants were subsequently eluted with elution buffer (50 mM $NaH_2PO_4$, 100 mM NaCl, 30 mM HAc and 70 mM NaAc, pH 5.0).

The purification under denatured conditions was performed as follows: Approximately 2-5 g of each cell pellet was resuspended in 10 ml lysis buffer (7 M guanidinium hydrochloride, 47 mM $Na_2HPO_4$, 2.65 mM $NaH_2PO_4$, 10 mM Tris-HCl, 104 mM NaCl, pH 8.0) followed by incubation at 37° C., 150 rpm for 2 h. The washing and elution steps were performed as for the native purification but using different buffers (wash buffer: 6 M guanidinium hydrochloride, 47 mM $Na_2HPO_4$, 3.4 mM $NaH_2PO_4$, 300 mM NaCl, pH 8.0; elution buffer: 6 M urea, 0.1 M NaCl, 29.6 mM HAc, 70.4 mM NaAc and 50 mM $NaH_2PO_4$, pH 5.0). Purified Z variants were buffer exchanged to PBS using PD-10 columns (GE Healthcare) according to the manufacturer's protocol.

Protein concentrations were determined by measuring the absorbance at 280 nm using the extinction coefficient of the respective protein. The purity of the IL-6 binding Z variants was analyzed by SDS-PAGE stained with Coomassie Blue.

Purification of IL-6 Binding Z Variants in Fusion with ABD:

Approximately 2.5 g of each cell pellet was re-suspended in 20 ml TST-buffer (25 mM Tris-HCl, 1 mM EDTA, 200 mM NaCl, 0.05% Tween20, pH 8.0) supplemented with Benzonase® (Merck). After cell disruption by sonication and clarification by centrifugation, each supernatant was applied on a gravity flow column with 1 ml anti-ABD agarose (WO2014/064237). After washing with TST-buffer and 5 mM $NH_4Ac$ pH 5.5 buffer, the ABD fused Z variants were eluted with 0.1 M HAc. Buffer exchange to PBS (2.68 mM KCl, 137 mM NaCl, 1.47 mM $KH_2PO_4$, 8.1 mM $Na_2HPO_4$, pH 7.4) was performed using PD-10 columns (GE Healthcare). Next, the ABD fused Z variants were purified on 1 ml Detoxi-Gel Endotoxin Removing Columns (Pierce, cat. no. 20344) to ensure low endotoxin content. Protein concentrations were determined by measuring the absorbance at 280 nm, using the extinction coefficient of the respective protein. The purity was analyzed by SDS-PAGE stained with Coomassie Blue and the identity of each purified Z-ABD variant was confirmed using LC/MS analysis.

Analysis of Binding Site:

A first assay was employed to evaluate the interference of the IL-6 binding Z variants with the interaction between hIL-6 and the human IL-6Rα (hIL-6Rα). In this experiment, half area 96-well ELISA plates were coated with anti-IL-6R capture antibody (R&D Systems) at a concentration of 2 µg/ml. Plates were incubated overnight at 4° C. and then washed twice in tap water. Next, the plates were blocked for 1 h in PBSC, and hIL-6Rα (R&D Systems) was added at a concentration of 250 ng/ml. Plates were incubated for 1.5 h at RT and then washed 4 times with 200 µl 0.05% Tween/PBS. In separate plates, serial dilutions (concentration range 500-0.5 nM) of the 13 $His_6$-tagged Z variant polypeptides were titrated with 2.5 nM of biotinylated hIL-6. The IL-6Rα antibody tocilizumab (Roche) was prepared in the same way and included for comparison. Each pre-mixed complex of Z variant and biotinylated hIL-6 was then transferred to wells containing hIL-6Rα. Plates were incubated for another 1.5 h and then washed four times. A 1:8000 dilution of streptavidin-HRP (Thermo Scientific) was added and the plates were incubated for 1 h. Plates were washed a final four times with 0.05% Tween/PBS and TMB substrate (Thermo Scientific) was added for 15 min before the reaction was stopped with 2 M $H_2SO_4$. The absorbance was measured at 450 nm using a microplate reader (Victor$^3$, Perkin Elmer).

A second assay was employed to evaluate the interference of the IL-6 binding Z variants on the interaction between human gp130 (hgp130) and the hIL-6/hIL-6Rα complex. In this experiment, half area 96-well ELISA plates were coated with Fc-fused hgp130 (hgp130-Fc) at a concentration of 4 µg/ml. Plates were incubated overnight at 4° C. and then washed twice in tap water. Next, the plates were blocked for 1 h in PBSC. Plates were incubated for 1.5 h at RT and then washed 4 times with 200 µl 0.05% Tween/PBS. In separate plates, serial dilutions (concentration range 500-0.5 nM) of the 13 $His_6$-tagged Z variant polypeptides were titrated with fixed concentration of hIL-6/hIL-6Rα (0.5 nM and 5 nM, respectively).

The IL-6Rα binding antibody tocilizumab (Roche) was prepared in the same way and included for comparison. The pre-mixed complex of each Z variant polypeptide and hIL- 6/hIL-6Rα was then transferred to wells containing hgp130. Plates were incubated for 1.5 h and then washed 4 times. A biotinylated anti-IL-6Rα antibody (R&D Systems) was added and the plates were incubated for another 1.5 h followed by washing. A 1:8000 dilution of streptavidin-HRP (Thermo Scientific) was added and the plates were incubated for 1 h. Next, plates were washed four times and TMB substrate (Thermo Scientific) was added for 15 min before the reaction was stopped with 2 M $H_2SO_4$. The absorbance was measured at 450 nm using a microplate reader (Victor$^3$, Perkin Elmer).

In Vitro Neutralization Assays:

A first assay, evaluating the classical signaling pathway, used the TF-1 cell line that proliferates in response to human IL-6, TNF and GM-CSF. TF-1 cells were cultured in RPMI1640 with L-glut (Lonza) supplemented with 10% FCS (Gibco), Pen-Strep (Lonza) and 2 ng/ml rhGM-CSF (R&D Systems). Prior to use, cells were washed twice in RPMI1640 in the absence of rhGM-CSF. Cells were then counted and dispensed into 96 well flat bottomed plates at a density of 4×10$^4$ cells per well. In separate plates, serial dilutions of the inhibitory compounds (IL-6 binding Z variants, with a His$_6$-tag (concentration range 1000-0.1 nM) or in fusion with the ABD variant PP013 (SEQ ID NO:1554, concentration range 200-0.007 nM)), and the IL-6Rα binding antibody tocilizumab (Roche; concentration range 200-0.007 nM) were incubated in the presence of 0.099 nM rhIL-6 (R&D Systems, UK). In addition, the ABD-fused variants were incubated with or without 9 µM rhHSA (Novozymes). The pre-mixed complexes of the Z variant polypeptides and hIL-6 were then transferred to wells containing TF-1 cells which were incubated for 72 h at 37° C. in a humidified 5% CO$_2$ atmosphere. During the last four hours of incubation 10 µl of CCK-8 (Fluke, Sigma Aldrich) was added per well to determine the number of proliferating cells. The absorbance was measured at 450 nm (Abs450) using a microplate reader (Victor$^3$, Perkin Elmer). The data on cell growth was assessed by non-linear regression to a four-parameter dose-response curve, and the half maximal inhibitory concentration (IC50) was determined using GraphPadPrism program. The inhibition of IL-6-dependent proliferation of TF-1 cells by the inhibitory molecules was as Abs450 minus control wells that contained cells but no hIL-6.

To address the trans-signaling pathway, a second assay was used. Herein, human umbilical vein endothelial cells (HUVECs) were stimulated with hIL-6 and soluble hIL-6Rα and the readout was the production of monocyte chemoattractant protein-1 (MCP-1). HUVECs (Lonza) were grown in EGM-2 bullet kit media (Lonza) and passaged in culture no more than eight times. Cells were grown until 75% confluence before use. Cells were detached using trypsin/EDTA (Lonza), resuspended and washed once in fresh medium. Next, cells were counted and dispensed into 96 well flat bottom plates at a density of 2×10$^4$ cells per well. Cells were cultured overnight at 37° C. in a humidified 5% CO$_2$ atmosphere. In separate plates, serial dilutions (100-0.0015 nM) of the IL-6 binding Z variants Z06789, Z06799, Z06809, Z06814 and Z06829 in fusion with the ABD variant PP013 (SEQ ID NO:1554), PP013-fused negative control Z03638 (SEQ ID NO:1552) binding a different target, and serial dilutions (200-0.003 nM) of tocilizumab (Roche) were incubated in the presence of recombinant hIL-6 (10 ng/ml; 0.5 nM) and soluble hIL-6Rα at a fixed concentration of 200 ng/ml (5.6 nM) with or without 9 µM rhHSA (Novozymes). The pre-mixed solutions with the test molecules and hIL-6/hIL-6Rα were then transferred to wells containing HUVECs, which were incubated for 24 h at 37° C. in a humidified 5% CO$_2$ atmosphere. Cell free supernatant was collected after the incubation period and human MCP-1 levels were determined by sandwich ELISA using the MCP-1 Duoset ELISA development system (R&D Systems).

MCP-1 ELISA:

Half area 96-well ELISA plates were coated with anti-MCP-1 capture antibody (R&D Systems) at a concentration of 1 µg/ml. Plates were incubated overnight at 4° C., washed twice in tap water and blocked for 1 h in PBSC. Plates were then washed four times with 4×200 µl 0.05% Tween/PBS before standards and samples were added. Plates were incubated for 2 h at RT and washed before addition of 0.1 µg/ml biotinylated anti-MCP-1 antibody (R&D Systems). Plates were then incubated for another 1.5 h, then washed four times. Next, a 1:8000 dilution of streptavidin-HRP (Thermo Scientific) was added and the plates were incubated for 1 h. The plates were washed a final four times and TMB substrate (Thermo Scientific) was added for 20 min before the reaction was stopped with 2 M $H_2SO_4$. The absorbance was measured at 450 nm using a microplate reader (Victor$^3$, Perkin Elmer).

CD Analysis:

A subset of the purified His$_6$-tagged Z variants was diluted to 0.5 mg/ml in PBS. For each diluted Z variant, a CD spectrum at 250-195 nm was obtained at 20° C. In addition, a variable temperature measurement (VTM) was performed to determine the melting temperature (Tm). In the VTM, the absorbance was measured at 221 nm while the temperature was raised from 20 to 90° C., with a temperature slope of 5° C./min. The CD measurements were performed on a Jasco J-810 spectropolarimeter (Jasco Scandinavia AB) using a cell with an optical path-length of 1 mm.

Results

Cultivation and Purification:

The 13 IL-6 binding Z variants (SEQ ID NO:1503-1515), constructed with an N-terminal His$_6$ tag, were produced in *E. coli*. The amount of IMAC-purified protein from approximately 2-5 g bacterial pellets, determined spectrophotometrically by measuring the absorbance at 280 nm, ranged from approximately 10 mg to 20 mg for the different IL-6 binding Z variants. 2 mg to 12 mg were obtained from approximately 2.5 g bacterial pellet of the five Z variants fused to the ABD variant PP013 (SEQ ID NO:1554). SDS-PAGE analysis of each final protein preparation showed that these predominantly contained the IL-6 binding Z variant. The correct identity and molecular weight of each IL-6 binding Z variant was confirmed by HPLC-MS analysis.

Figure 3:
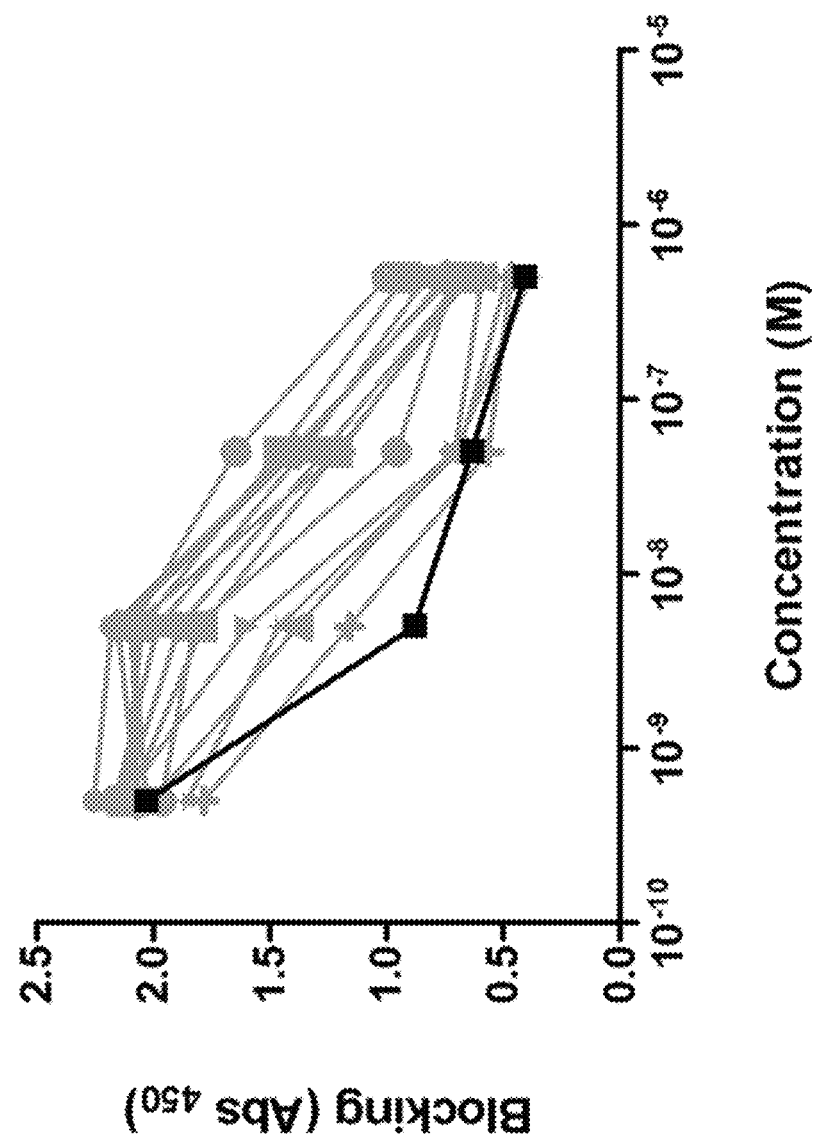
FIG. 3 shows the result of blocking of the binding of the hIL-6/hIL-6Rα complex to hgp130, assayed as described in Example 2. Concentration dependent blocking was seen for all tested primary IL-6 binding Z variants (gray) as well as for tocilizumab (black), which was included for comparison. The calculated IC50 value of each variant is shown in Table 3.

Analysis of Binding Site:

The ability of the 13 tested IL-6 binding His$_6$-tagged Z variants to block the interactions between either (i) hIL-6 and hIL-6Rα or (ii) hgp130 and preformed hIL-6/hIL-6Rα complex was investigated in two separate competitive ELISA experiments. None of the 13 Z variants showed any significant effect when tested for blocking of the hIL-6/hIL-6Rα interaction (FIG. 2). However, all Z variants showed a clear concentration-dependent blocking of the interaction between pre-formed hIL-6/hIL-6Rα and hgp130, i.e. the trans-signaling-resembling interaction (FIG. 3). The calculated IC50 value for each Z variant is shown in Table 3. The antibody tocilizumab, included for comparison, showed a blocking effect in both experiments.

TABLE 3

IC50 values for primary Z variants blocking
the hIL-6/hIL-6Rα interaction with hgp130

| Z variant | SEQ ID NO of Z variant: | IC50 (M) |
|---|---|---|
| His$_6$-Z06777 | 1503 | $4.6 \times 10^{-8}$ |
| His$_6$-Z06779 | 1504 | $3.6 \times 10^{-8}$ |
| His$_6$-Z06789 | 1505 | $6.2 \times 10^{-9}$ |
| His$_6$-Z06791 | 1506 | $2.3 \times 10^{-8}$ |
| His$_6$-Z06792 | 1507 | $1.7 \times 10^{-8}$ |
| His$_6$-Z06799 | 1508 | $3.7 \times 10^{-9}$ |
| His$_6$-Z06802 | 1509 | $2.7 \times 10^{-8}$ |
| His$_6$-Z06805 | 1510 | $4.2 \times 10^{-8}$ |
| His$_6$-Z06809 | 1511 | $3.3 \times 10^{-9}$ |
| His$_6$-Z06814 | 1512 | $1.6 \times 10^{-9}$ |
| His$_6$-Z06829 | 1513 | $1.1 \times 10^{-8}$ |
| His$_6$-Z06834 | 1514 | $5.3 \times 10^{-8}$ |
| His$_6$-Z06844 | 1515 | $8.7 \times 10^{-8}$ |

In Vitro Neutralization Assays:

Two different cell assays were used for investigating the ability of the IL-6 binding Z variants to block IL-6 dependent signaling in the classical signaling pathway and the trans-signaling pathway, respectively. The first assay, evaluating the classical signaling pathway, employed the TF-1 cell line that proliferates in response to human IL-6, TNF and GM-CSF. The direct signaling of IL-6 to cell surface IL-6 receptor, in conjunction with a signaling receptor sub-unit called gp130, is termed cis-signaling. This assay showed that all 13 variants were capable of blocking IL-6 dependent growth of the TF-1 cells. The calculated 1050 values for His$_6$-tagged Z variants and Z variants recombinantly fused to the ABD variant PP013 (SEQ ID NO:1554), as well as for the hIL-6Rα binding antibody tocilizumab included for comparison, are shown in Table 4.

TABLE 4

IC50 values for primary Z variants blocking
the IL-6 dependent growth of TF-1 cells

| Z variant | SEQ ID NO of Z variant: | IC50 (M) |
|---|---|---|
| His$_6$-Z06777 | 1503 | $7.2 \times 10^{-8}$ |
| His$_6$-Z06779 | 1504 | $3.0 \times 10^{-8}$ |
| His$_6$-Z06789 | 1505 | $8.6 \times 10^{-9}$ |
| His$_6$-Z06791 | 1506 | $5.2 \times 10^{-9}$ |
| His$_6$-Z06792 | 1507 | $5.3 \times 10^{-8}$ |
| His$_6$-Z06799 | 1508 | $3.9 \times 10^{-9}$ |
| His$_6$-Z06802 | 1509 | $4.3 \times 10^{-8}$ |
| His$_6$-Z06805 | 1510 | $7.7 \times 10^{-8}$ |
| His$_6$-Z06809 | 1511 | $2.0 \times 10^{-8}$ |
| His$_6$-Z06814 | 1512 | $1.6 \times 10^{-9}$ |
| His$_6$-Z06829 | 1513 | $2.8 \times 10^{-8}$ |
| His$_6$-Z06834 | 1514 | $6.1 \times 10^{-8}$ |
| His$_6$-Z06844 | 1515 | $1.1 \times 10^{-7}$ |
| Z06789-ABD | 1505 | $\sim 1 \times 10^{-7}$ |
| Z06799-ABD | 1508 | $2.4 \times 10^{-8}$ |
| Z06809-ABD | 1511 | $1.0 \times 10^{-8}$ |
| Z06814-ABD | 1512 | $8.0 \times 10^{-10}$ |
| Z06829-ABD | 1513 | $1.5 \times 10^{-8}$ |
| tocilizumab | | $3.0 \times 10^{-10}$ |

Figure 4:
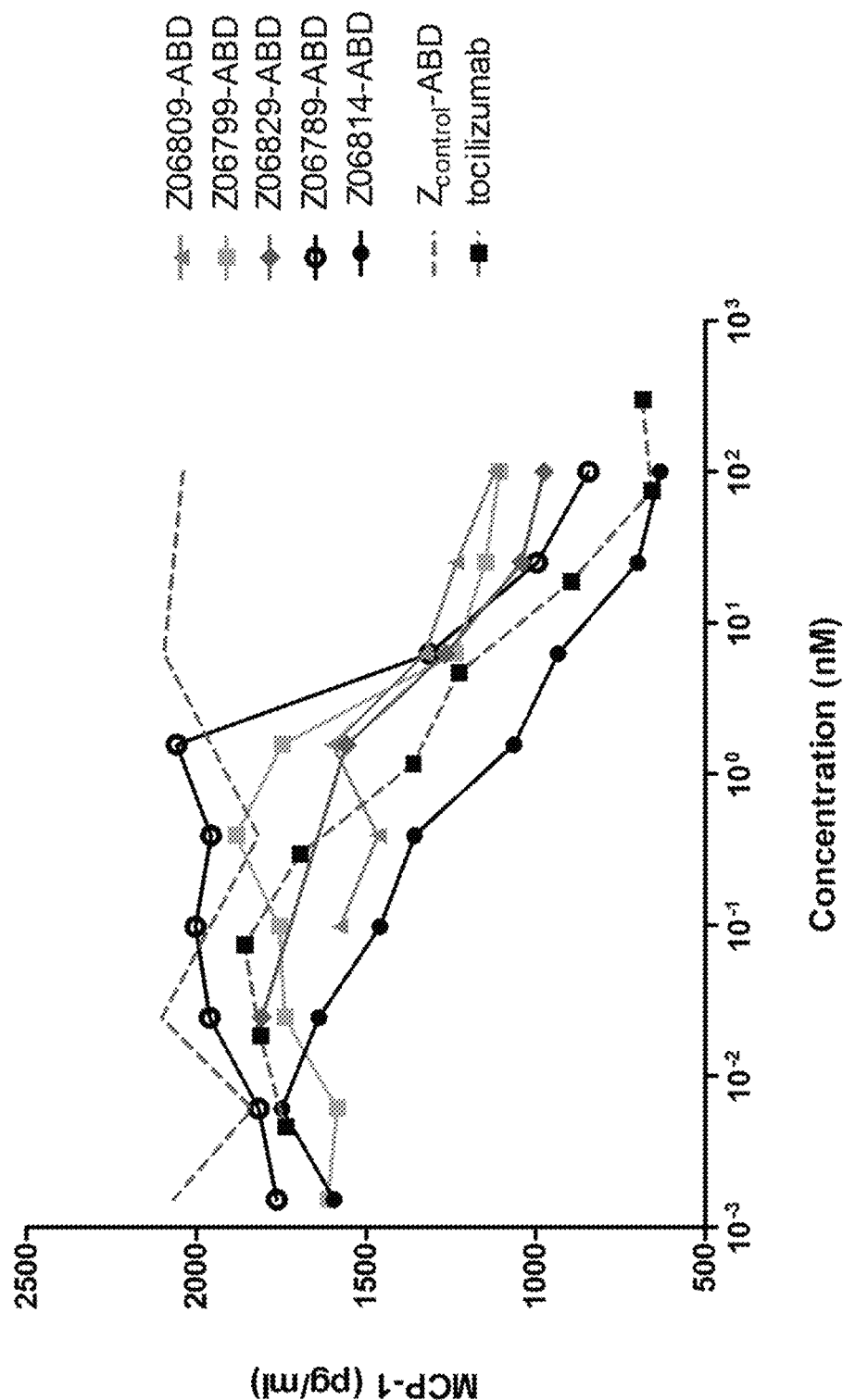
FIG. 4 shows concentration dependent inhibition of IL-6 mediated trans-signaling in a gp130 expressing human umbilical vein endothelial cell (HUVEC) based system, assayed as described in Example 2. IL-6 binding Z variants C-terminally fused to the ABD variant PP013 (SEQ ID NO:1554) inhibited the trans-signaling, whereas the control Z variant Z03638 (SEQ ID NO:1552) in fusion with PP013 did not. Tocilizumab was included for comparison.

To investigate if also the trans-signaling pathway could be blocked in a cell based system, a second assay using gp130 expressing human umbilical vein endothelial cells (HUVECs) was performed. Incubation of HUVECs with pre-formed hIL-6/hIL-6Rα complexes results in IL-6 trans-signaling dependent secretion of Monocyte Chemoattractant Protein-1 (MCP-1), allowing for analysis of any trans-signaling blocking capabilities of IL-6 binding Z variants. In this assay, five Z variants recombinantly fused to the ABD variant PP013 (SEQ ID NO:1554) were analyzed in the presence of HSA. The hIL-6Rα binding antibody tocilizumab was included for comparison. All five investigated Z variants were shown to inhibit trans-signaling (FIG. 4). One variant, Z06814-ABD, was shown to be more potent than tocilizumab and exhibited an approximate IC50 value of 1 nM compared to 5 nM for tocilizumab.

CD Analysis:

The CD spectra determined for seven Z variants showed that each had an α-helical structure at 20° C. The melting temperatures (Tm) determined through variable temperature measurements are shown in Table 5.

TABLE 5

Melting temperatures for a selection of Z variants

| Z variant | SEQ ID NO: | Tm (° C.) |
|---|---|---|
| His$_6$-Z06779 | 1504 | 51 |
| His$_6$-Z06789 | 1505 | 52 |
| His$_6$-Z06792 | 1507 | 48 |
| His$_6$-Z06799 | 1508 | 44 |
| His$_6$-Z06809 | 1511 | 51 |
| His$_6$-Z06814 | 1512 | 49 |
| His$_6$-Z06829 | 1513 | 40 |

Example 3

Design and Construction of a First Maturated Library of IL-6 Binding Z Variants

In this Example, a maturated library was constructed. The library was used for selections of new IL-6 binding Z variants. Selections from maturated libraries are usually expected to result in binders with increased affinity (Orlova et al., (2006) Cancer Res 66(8):4339-48). In this study randomized single stranded linkers were generated, using split-pool synthesis, enabling incorporation of defined codons in desired positions in the synthesis.

Materials and Methods

Library Design:

The library was based on a selection of sequences of the IL-6 binding Z variants described in Example 1 and 2. In the new library, 12 variable positions in the Z molecule scaffold were biased towards certain amino acid residues and one position was kept constant, according to a strategy based on the Z variant sequences defined in SEQ ID NO:1503-1551. Using split-pool synthesis, a DNA linker of 147 bp was generated, encoding a partially randomized helix 1 and 2 of the Z variant amino acid sequence. Thus, 5'-AA ATA AAT CTC GAG GTA GAT GCC AAA TAC GCC AAA GAA NNN NNN NNN GCG TGG NNN GAG ATC NNN NNN CTG CCT AAC CTC ACC NNN NNN CAA NNN NNN GCC TTC ATC NNN AAA TTA NNN GAT GAC CCA AGC CAG AGC TCA TTA TTT A-3' (SEQ ID NO:1560, randomized codons denoted NNN) flanked by restriction sites XhoI and SacI, was ordered from DNA 2.0 (Menlo Park, Calif., USA). The theoretical distributions of amino acid residues in the new library including 12 variable positions (9, 10, 11, 14, 17, 18, 24, 25, 27, 28, 32 and 35) in the Z molecule scaffold are given in Table 6. The resulting theoretical library size is $3.6 \times 10^9$ variants.

TABLE 6

Library design, first maturation

| Amino acid position in Z | Randomization (amino acid abbreviations) | No of amino acids | Proportion |
|---|---|---|---|
| 9 | E (70%), H, Q, T, | 4 | 1/10, 7/10 (E) |
| 10 | A, H, Q, R, | 4 | 1/4 |
| 11 | A, D, E, H, K, Q, R, S, T, V | 10 | 1/10 |
| 13 | W | 1 | 1/1 |
| 14 | A, F, H, L, R, S, T, W, Y | 9 | 1/9 |
| 17 | H (70%), Q, S, T | 4 | 1/10, 7/10 (H) |
| 18 | A, H, I, K, L, M, S, T, V | 9 | 1/9 |
| 24 | A, H, I, T, V | 5 | 1/5 |
| 25 | D, E, H, N, Q, R, S, T | 8 | 1/8 |
| 27 | A, H, I, L, M, R, T, V | 8 | 1/8 |
| 28 | A, E, H, S, T, V | 6 | 1/6 |
| 32 | A, H, I, M, Q, S, T, V, W | 9 | 1/9 |
| 35 | F, L, M, Y | 4 | 1/4 |

Library Construction:

The library was amplified using AmpliTaq Gold polymerase (Applied Biosystems, cat. no. 4311816) during 12 cycles of PCR and pooled products were purified with QIAquick PCR Purification Kit (QIAGEN, cat. no. 28106) according to the supplier's recommendations. The purified pool of randomized library fragments was digested with restriction enzymes XhoI and SacI-HF (New England Biolabs, cat. no. R0146L, and cat. no. R3156M) and concentrated using a PCR Purification Kit (Qiagen, cat. no. 28106). Subsequently, the product was run on a preparative 2.5% agarose gel (Nuisieve GTC agarose, Cambrex, Invitrogen) and purified using a QIAGEN gel extraction Kit (QIAGEN, cat. no. 28706) according to the supplier's recommendations.

The phagemid vector pAY02592 (essentially as pAffi1 described in Grönwall et al, supra) was restricted with the same enzymes and purified using phenol/chloroform extraction and ethanol precipitation. The restricted fragments and vector were ligated in a molar ratio of 5:1 with T4 DNA ligase (Fermentas, cat. no. EL0011) for 2 h at RT, followed by overnight incubation at 4° C. The ligated DNA was recovered by phenol/chloroform extraction and ethanol precipitation, followed by dissolution in 10 mM Tris-HCl, pH 8.5. Thus, the resulting library in vector pAY02592 encoded Z variants, each fused to an albumin binding domain (ABD) derived from streptococcal protein G.

The ligation reactions (approximately 160 ng DNA/transformation) were electroporated into electrocompetent *E. coli* ER2738 cells (50 μl, Lucigen, Middleton, Wis., USA). Immediately after electroporation, approximately 1 ml of recovery medium (supplied with the ER2738 cells) was added. The transformed cells were incubated at 37° C. for 60 min. Samples were taken for titration and for determination of the number of transformants. Next, the cells were pooled and cultivated overnight at 37° C. in 1 l of TSB-YE medium, supplemented with 2% glucose, 10 μg/ml tetracycline and 100 μg/ml ampicillin. The cells were pelleted for 7 min at 4,000 g and resuspended in a PBS/glycerol solution (approximately 40% glycerol), aliquoted and stored at −80° C. Clones from the library of Z variants were sequenced in order to verify the content and to evaluate the outcome of the constructed library vis-à-vis the library design. Sequencing was performed as described in Example 1 and the amino acid distribution was verified.

Preparation of Phage Stock:

Phage stock containing the phagemid library was prepared in a 20 l fermenter (Belach Bioteknik). Cells from a glycerol stock containing the phagemid library were inoculated in 10 l of TSB-YE (Tryptic Soy Broth-Yeast Extract; 30 g/l TSB, 5 g/l yeast extract) supplemented with 1 g/l glucose, 100 mg/l ampicillin and 10 mg/l tetracycline. When the cells reached an optical density at 600 nm ($OD_{600}$) of 0.64, approximately 1.1 l of the cultivation was infected using a 5× molar excess of M13K07 helper phage. The cells were incubated for 30 min, whereupon the fermenter was filled up to 10 l with complex fermentation medium [2.5 g/l $(NH_4)_2SO_4$, 5.0 g/l yeast extract; 30 g/l tryptone, 2 g/l $K_2HPO_4$; 3 g/l $KH_2PO_4$, 1.25 g/l, $Na_3C_6H_5O_7.2H_2O$; Breox FMT30 antifoaming agent 0.1 ml/l]. The following components were added: 10 ml carbenicillin 25 mg/ml, 5 ml kanamycin 50 mg/ml, 1 ml 1 M isopropyl-8-D-1-thiogalactopyranoside (IPTG); 17.5 ml/l of 300 g/l $MgSO_4$ and 5 ml of a trace element solution [35 g/l $FeCl_3.6H_2O$; 10.56 g/l $ZnSO_4.7H_2O$; 2.64 g/l $CuSO_4.5H_2O$; 13.2 g/l $MnSO_4.H_2O$; 13.84 g/l $CaCl_2.2H_2O$, dissolved in 1.2 M HCl]. A glucose limited fed-batch cultivation was started where a 600 g/l glucose solution was fed to the reactor (3.5 g/h in the start, 37.5 g/h after 20 h and until the end of the cultivation). The pH was controlled at pH 7 through the automatic addition of 25% $NH_4OH$. Air was supplemented (5 l/min) and the stirrer was set at 500 rpm. After 24 h of fed-batch cultivation the $OD_{600}$ was 22. The cells in the cultivation were pelleted by centrifugation at 15,900 g. The phage particles were precipitated twice from the supernatant in PEG/NaCl, filtered and dissolved in PBS and glycerol as described in Example 1. Phage stocks were stored at −80° C. until use in selection.

Results

Library Construction:

The new library was designed based on a set of IL-6 binding Z variants with verified binding properties (Example 1 and 2). The theoretical size of the designed library was 3.6×10⁹ Z variants. The actual size of the library, determined by titration after transformation to *E. coli* ER2738 cells, was 3.5×10⁹ transformants.

The library quality was tested by sequencing of 192 transformants and by comparing their actual sequences with the theoretical design. The contents of the actual library compared to the designed library were shown to be satisfactory. A maturated library of potential binders to IL-6 was thus successfully constructed.

Example 4

Selection, Screening and Characterization of Z Variants from the First Maturated Library Materials and Methods Phage Display Selection of Matured IL-6 Binding Z Variants:

The target proteins hIL-6 (R&D Systems, cat. no. 206-IL/CF) and mIL-6 (Abnova, cat. no. P4346 I16) were biotinylated as described in Example 1. Phage display selections, using the new library of Z variant molecules described in Example 3, were performed in four cycles against hIL-6 and mIL-6 essentially as described in Example 1 with the following exceptions. At selection, fetal calf serum (FCS, Gibco, cat. no. 10108-165) and human serum albumin (HSA, Albucult, Novozymes, cat. no. 230-005) were added to the selection buffer to a final concentration of 10% and 1.5 μM, respectively. All tubes and beads used in the selection were pre-blocked with PBST 0.1% supplemented with 3% BSA. In cycle 1A, a pre-selection step was performed by incubation of phage stock with SA-beads. The selection volume was 2 ml in cycle 1 for all tracks. For capture of phage-target complexes, 1 mg beads per 4 µg biotinylated hIL-6 or mIL-6 was used.

The six tracks (1-6) in cycle 1 were divided either in the second cycle or the third cycle, resulting in totally seven tracks (1-1 to 6-2) in cycle 2, twelve tracks (1-1-1 to 6-2-1) in cycle 3 and twelve tracks (1-1-1-1 to 6-2-1-1) in cycle 4.

The bound phage particles were eluted using two different procedures; 1) 500 µl 0.1 M glycine-HCl, pH 2.2, followed by immediate neutralization with 50 µl 1 M Tris-HCl, pH 8.0, and 450 µl PBS, or 2) 500 µl of 100 mM sodium phosphate and 150 mM sodium chloride, pH 5.5 and neutralization with 500 µl PBS.

An overview of the selection strategy, describing an increased stringency in subsequent cycles obtained by using a lowered target concentration and an increased number of washes, is shown in Table 7.

TABLE 7

Overview of the selection strategy for the first maturation

| Cycle | Selection track | Phage stock from library or selection track | Target | Target concentration (nM) | Number of washes | Elution at |
|---|---|---|---|---|---|---|
| 1 | 1 | Zlib006IL-6.I | hIL-6 | 50 | 2 | pH 2.2 |
| 1 | 2 | Zlib006IL-6.I | hIL-6 | 25 | 2 | pH 2.2 |
| 1 | 3 | Zlib006IL-6.I | hIL-6 | 10 | 3 | pH 2.2 |
| 1 | 4 | Zlib006IL-6.I | hIL-6 | 50 | 2 | pH 5.45 |
| 1 | 5 | Zlib006IL-6.I | hIL-6 | 25 | 2 | pH 5.45 |
| 1 | 6 | Zlib006IL-6.I | mIL-6 | 100 | 2 | pH 2.2 |
| 2 | 1-1 | 1 | hIL-6 | 25 | 8 | pH 2.2 |
| 2 | 2-1 | 2 | hIL-6 | 10 | 8 | pH 2.2 |
| 2 | 3-1 | 3 | hIL-6 | 2.5 | 12 | pH 2.2 |
| 2 | 4-1 | 4 | hIL-6 | 25 | 8 | pH 5.45 |
| 2 | 5-1 | 5 | hIL-6 | 10 | 8 | pH 5.45 |
| 2 | 6-1 | 6 | mIL-6 | 100 | 4 | pH 2.2 |
| 2 | 6-2 | 6 | mIL-6 | 50 | 6 | pH 2.2 |
| 3 | 1-1-1 | 1-1 | hIL-6 | 5 | 12 | pH 2.2 |
| 3 | 1-1-2 | 1-1 | hIL-6 | 1.25 | 15 | pH 2.2 |
| 3 | 2-1-1 | 2-1 | hIL-6 | 1.25 | 12 | pH 2.2 |
| 3 | 2-1-2 | 2-1 | hIL-6 | 0.5 | 15 | pH 2.2 |
| 3 | 3-1-1 | 3-1 | hIL-6 | 0.5 | 20 | pH 2.2 |
| 3 | 3-1-2 | 3-1 | hIL-6 | 0.05 | 20 | pH 2.2 |
| 3 | 4-1-1 | 4-1 | hIL-6 | 5 | 12 | pH 5.45 |
| 3 | 4-1-2 | 4-1 | hIL-6 | 1.25 | 15 | pH 5.45 |
| 3 | 5-1-1 | 5-1 | hIL-6 | 2.5 | 12 | pH 5.45 |
| 3 | 5-1-2 | 5-1 | hIL-6 | 1 | 15 | pH 5.45 |
| 3 | 6-1-1 | 6-1 | mIL-6 | 50 | 11 | pH 2.2 |
| 3 | 6-2-1 | 6-2 | mIL-6 | 25 | 11 | pH 2.2 |
| 4 | 1-1-1-1 | 1-1-1 | hIL-6 | 0.5 | 16 | pH 2.2 |
| 4 | 1-1-2-1 | 1-1-2 | hIL-6 | 0.05 | 20 | pH 2.2 |
| 4 | 2-1-1-1 | 2-1-1 | hIL-6 | 0.1 | 16 | pH 2.2 |
| 4 | 2-1-2-1 | 2-1-2 | hIL-6 | 0.025 | 20 | pH 2.2 |
| 4 | 3-1-1-1 | 3-1-1 | hIL-6 | 0.025 | 30 | pH 2.2 |
| 4 | 3-1-2-1 | 3-1-2 | hIL-6 | 0.0025 | 30 | pH 2.2 |
| 4 | 4-1-1-1 | 4-1-1 | hIL-6 | 1 | 16 | pH 5.45 |
| 4 | 4-1-2-1 | 4-1-2 | hIL-6 | 0.1 | 20 | pH 5.45 |
| 4 | 5-1-1-1 | 5-1-1 | hIL-6 | 0.2 | 16 | pH 5.45 |
| 4 | 5-1-2-1 | 5-1-2 | hIL-6 | 0.05 | 20 | pH 5.45 |
| 4 | 6-1-1-1 | 6-1-1 | mIL-6 | 10 | 12 | pH 2.2 |
| 4 | 6-2-1-1 | 6-2-1 | mIL-6 | 1 | 16 | pH 2.2 |

Amplification of Phage Particles:

Amplification of phage particles between selection cycle 1 and 2 was performed essentially as described in Example 1, with the following exceptions. E. coli ER2738 was used for phage amplification and M13K07 helper phage was used in 5× excess. The amplification of phage particles between the selection cycles 2 and 4 was done by infection of bacteria in solution according to the following. After infection of log phase E. coli ER2738 with phage particles, TSB supplemented with 2% glucose, 10 µg/ml tetracycline and 100 µg/ml ampicillin was added, followed by incubation with rotation for 30 min at 37° C. Thereafter, the bacteria were infected with M13K07 helper phage. The infected bacteria were pelleted by centrifugation, re-suspended in TSB-YE medium supplemented with 100 µM IPTG, 25 µg/ml kanamycin and 100 µg/ml ampicillin, and grown overnight at 30° C. The overnight cultures were centrifuged and phage particles in the supernatant were precipitated twice with PEG/NaCl buffer. Finally, the phage particles were re-suspended in selection buffer before entering the next selection cycle. In the last selection cycle, log phase bacteria were infected with eluate and diluted before spreading onto TBAB plates (30 g/l tryptose blood agar base, Oxoid cat. no. CMO233B) supplemented with 0.2 g/l ampicillin in order to form single colonies for use in ELISA screening.

Sequencing of Potential Binders:

Individual clones from the different selection tracks were picked for sequencing. All clones run in the ELISA screening were sequenced. Amplification of gene fragments and sequence analysis of gene fragments were performed essentially as described in Example 1.

ELISA Screening of Z Variants:

Single colonies containing Z variants (expressed as Z variant ABD fusion proteins) were randomly picked from the selected clones of the IL-6 maturated library and cultivated as described in Example 1. Preparation of the periplasmic supernatants was performed as in Example 1 but with six freeze thawing cycles. ELISA screenings were performed essentially as described in Example 1 using biotinylated hIL-6 at a concentration of 0.58 nM. The periplasmic fraction of the primary IL-6 binder Z06814 was used as a positive control. A negative control was created by using periplasm containing ABD only.

ELISA EC50 Analysis of Human IL-6 Binders:

A selection of IL-6 binders was subjected to an analysis of the response against a dilution series of biotinylated hIL-6 using ELISA as described above. Biotinylated protein was added at a concentration of 25 nM and diluted stepwise 1:3 down to 11 pM. All Z variants were also assayed without added target protein as a background control. Periplasm samples containing the primary IL-6 binder Z06814 (SEQ ID. NO:1512) were included and analyzed as a positive control. As a negative control, periplasm containing ABD only was assayed against biotinylated hIL-6. Two binders originating from the selection against mIL-6, Z11612 (SEQ ID NO:151) and Z11616 (SEQ ID NO:152) were subjected to an analysis of the response against a dilution series of biotinylated mIL-6 using ELISA as described above. Biotinylated protein was added at a concentration of 227 nM and diluted stepwise 1:3 down to 104 pM. Obtained values were analyzed using GraphPad Prism 5 and non-linear regression.

Results

Phage Display Selection of Maturated IL-6 Binding Z Variants:

Selection was performed in totally 12 parallel tracks containing four cycles each. The different selection tracks differed in target concentration, target type (hIL-6 or mIL-6), selection time, wash conditions and the pH of the elution buffer.

Sequencing:

Randomly picked clones were sequenced. Each individual Z variant was given an identification number, Z #####, as described in Example 1. In total, 809 new unique Z variant molecules were identified.

The amino acid sequences of 58 residues long Z variants are listed in FIG. 1A-VV and in the sequence listing as SEQ ID NO:7, SEQ ID NO:15-89 and SEQ ID NO:151-871. The deduced IL-6 binding motifs (BM) extend from position 8 to position 36 in each sequence. The amino acid sequences of the 49 amino acid residues long polypeptides predicted to constitute the complete three-helix bundle within each of these Z variants (BMod) extend from position 7 to position 55.

ELISA Screening of Z Variants:

Clones obtained after four selection cycles were produced in 96-well plates and screened for hIL-6 binding activity using ELISA. All randomly picked clones were analyzed. 796 of the 809 unique Z variants were found to give a response of 3× the negative control or higher (0.3-2.1 AU) against hIL-6 at a concentration of 0.58 nM. Clones from all selection tracks using hIL-6 as selection target showed positive signals. The negative controls had absorbencies of 0.078-0.102 AU. The average response of the blank controls of a representative set of plates was 0.087 AU.

ELISA EC50 Analysis of IL-6 Binders:

A subset of Z variants was selected based on the result in the ELISA experiment described above (highest ELISA value normalized against the positive control on each plate, respectively) and subjected to a target titration in ELISA format. Periplasm samples were incubated with a serial dilution of biotinylated hIL-6 or mIL-6. A periplasm sample with the primary binder Z06814 (SEQ ID NO:1512) was also assayed against hIL-6 as a positive control. Obtained values were analyzed and their respective EC50 values were calculated (Tables 8 and 9).

TABLE 8

Calculated EC50 values against hIL-6

| Z variant | SEQ ID NO | EC50 ELISA (M) |
|---|---|---|
| Z11213 | 15 | $1.5 \times 10^{-10}$ |
| Z11214 | 16 | $1.3 \times 10^{-10}$ |
| Z11215 | 17 | $1.4 \times 10^{-10}$ |
| Z11217 | 18 | $1.3 \times 10^{-10}$ |
| Z11222 | 19 | $1.4 \times 10^{-10}$ |
| Z11251 | 20 | $1.4 \times 10^{-10}$ |
| Z11277 | 21 | $1.2 \times 10^{-10}$ |
| Z11278 | 22 | $1.5 \times 10^{-10}$ |
| Z11283 | 23 | $1.8 \times 10^{-10}$ |
| Z11300 | 24 | $1.9 \times 10^{-10}$ |
| Z11321 | 25 | $1.4 \times 10^{-10}$ |
| Z11329 | 26 | $1.4 \times 10^{-10}$ |
| Z11351 | 27 | $1.7 \times 10^{-10}$ |
| Z11380 | 28 | $1.7 \times 10^{-10}$ |
| Z11384 | 29 | $1.5 \times 10^{-10}$ |
| Z11433 | 30 | $2.1 \times 10^{-10}$ |
| Z11472 | 31 | $1.8 \times 10^{-10}$ |
| Z11552 | 32 | $1.2 \times 10^{-9}$ |
| Z11632 | 7 | $1.9 \times 10^{-10}$ |
| Z11642 | 33 | $2.3 \times 10^{-10}$ |
| Z11644 | 34 | $2.4 \times 10^{-10}$ |
| Z11674 | 35 | $2.6 \times 10^{-10}$ |
| Z11698 | 36 | $2.0 \times 10^{-10}$ |
| Z11711 | 37 | $3.5 \times 10^{-10}$ |
| Z11723 | 38 | $2.5 \times 10^{-10}$ |
| Z11781 | 39 | $2.9 \times 10^{-10}$ |
| Z11784 | 40 | $2.7 \times 10^{-10}$ |
| Z11788 | 41 | $2.5 \times 10^{-10}$ |
| Z11789 | 42 | $2.4 \times 10^{-10}$ |
| Z11791 | 43 | $3.4 \times 10^{-10}$ |

TABLE 8-continued

Calculated EC50 values against hIL-6

| Z variant | SEQ ID NO | EC50 ELISA (M) |
|---|---|---|
| Z11794 | 44 | $2.2 \times 10^{-10}$ |
| Z11802 | 45 | $2.6 \times 10^{-10}$ |
| Z11803 | 46 | $2.8 \times 10^{-10}$ |
| Z11805 | 47 | $3.4 \times 10^{-10}$ |
| Z11814 | 48 | $2.5 \times 10^{-10}$ |
| Z11815 | 49 | $2.8 \times 10^{-10}$ |
| Z11817 | 50 | $2.5 \times 10^{-10}$ |
| Z11818 | 51 | $2.4 \times 10^{-10}$ |
| Z11819 | 52 | $2.5 \times 10^{-10}$ |
| Z11823 | 53 | $2.1 \times 10^{-10}$ |
| Z11824 | 54 | $2.3 \times 10^{-10}$ |
| Z11833 | 55 | $2.9 \times 10^{-10}$ |
| Z11835 | 56 | $2.9 \times 10^{-10}$ |
| Z11836 | 57 | $3.6 \times 10^{-10}$ |
| Z11860 | 58 | $1.8 \times 10^{-10}$ |
| Z11861 | 59 | $2.2 \times 10^{-10}$ |
| Z11862 | 60 | $1.9 \times 10^{-10}$ |
| Z11865 | 61 | $2.3 \times 10^{-10}$ |
| Z11866 | 62 | $2.5 \times 10^{-10}$ |
| Z11871 | 63 | $1.7 \times 10^{-10}$ |
| Z11872 | 64 | $2.8 \times 10^{-10}$ |
| Z11874 | 65 | $3.1 \times 10^{-10}$ |
| Z11875 | 66 | $2.1 \times 10^{-10}$ |
| Z11881 | 67 | $1.7 \times 10^{-10}$ |
| Z11882 | 68 | $1.4 \times 10^{-10}$ |
| Z11883 | 69 | $2.1 \times 10^{-10}$ |
| Z11890 | 70 | $1.9 \times 10^{-10}$ |
| Z11892 | 71 | $2.3 \times 10^{-10}$ |
| Z11893 | 72 | $2.0 \times 10^{-10}$ |
| Z11895 | 73 | $2.8 \times 10^{-10}$ |
| Z11896 | 74 | $2.9 \times 10^{-10}$ |
| Z11897 | 75 | $3.0 \times 10^{-10}$ |
| Z11901 | 76 | $1.7 \times 10^{-10}$ |
| Z11903 | 77 | $2.3 \times 10^{-10}$ |
| Z11904 | 78 | $2.4 \times 10^{-10}$ |
| Z11905 | 79 | $3.1 \times 10^{-10}$ |
| Z11906 | 80 | $2.5 \times 10^{-10}$ |
| Z11907 | 81 | $3.6 \times 10^{-10}$ |
| Z11912 | 82 | $1.8 \times 10^{-10}$ |
| Z11918 | 83 | $3.2 \times 10^{-10}$ |
| Z11922 | 84 | $2.7 \times 10^{-10}$ |
| Z11923 | 85 | $2.1 \times 10^{-10}$ |
| Z11929 | 86 | $2.6 \times 10^{-10}$ |
| Z11933 | 87 | $1.6 \times 10^{-10}$ |
| Z11937 | 88 | $3.0 \times 10^{-10}$ |
| Z11939 | 89 | $2.1 \times 10^{-10}$ |
| Z06814 | 1512 | $2.9 \times 10^{-10}$ |

TABLE 9

Calculated EC50 values against mIL-6

| Z variant | SEQ ID NO | EC50 ELISA (M) |
|---|---|---|
| Z11612 | 151 | $9.3 \times 10^{-9}$ |
| Z11616 | 152 | $7.7 \times 10^{-9}$ |

Example 5

Design and Construction of a Second Maturated Library of IL-6 Binding Z Variants In this Example, a second maturated library was constructed essentially as described in Example 4. The library was used for selections of IL-6 binding Z variants.

Materials and Methods

Library Design:

The library was primarily based on a selection of sequences of the human IL-6 binding Z variants described in Example 4. In the new library, 13 variable positions in the Z molecule scaffold were biased towards certain amino acid residues, according to a strategy mainly based on the Z variants from the first maturation, i.e. sequences defined in SEQ ID NO:7, SEQ ID NO:15-89 and SEQ ID NO:151-871. Randomized double stranded linkers were generated by the Colibra™ technology, which enables incorporation of randomized sets of trinucleotide building blocks using ligations and restrictions of the subsequently built up double stranded DNA. A library of double-stranded DNA, 5'-AA ATA AAT CTC GAG GTA GAT GCC AAA TAC GCC AAA GAA NNN NNN NNN GCT NNN NNN GAG ATC NNN NNN CTG CCG AAC CTG ACC NNN NNN CAG NNN NNN GCC TTC ATC NNN AAA TTA NNN GAT GAC CCA AGC CAG AGC TCA TTA TTT A-3' (SEQ ID NO:1561, randomized codons are denoted NNN) encoding a partially randomized helix 1 and 2 of the Z variant amino acid sequence, flanked by restriction sites XhoI and SacI, was ordered from Isogenica (Essex, UK). The theoretical distributions of amino acid residues in the new library, including eight variable amino acid positions (10, 11, 14, 18, 24, 25, 27 and 32) and five constant amino acid positions (9, 13, 17, 28, and 35) in the Z molecule scaffold are given in Table 10. The resulting theoretical library size was $2.6 \times 10^7$ variants.

Library Construction and Phage Stock Preparation:

The library was constructed essentially as described in Example 3. Phage stock of the library was prepared as described in Example 3.

TABLE 10

Library design, second maturation

| Amino acid position in Z | Allowed amino acids | No of amino acids | Proportion |
|---|---|---|---|
| 9 | E | 1 | 1/1 |
| 10 | A, D, E, F, H, I, K, L, N, Q, R, S, T, V, W, Y | 1 | 1/16 |
| 11 | A, D, E, F, G, H, I, K, L, M, N, Q, R, S, T, V, W, Y | 17 | 1/18 |
| 13 | W | 1 | 1/1 |
| 14 | A, D, E, F, H, I, K, L, M, N, Q, R, S, T, V, W, Y | 7 | 1/17 |
| 17 | H | 1 | 1/1 |
| 18 | A, D, E, F, G, H, I, K, L, N, Q, R, S, T, V, W, Y | 17 | 1/17 |
| 24 | I, L, V | 1 | 1/3 |
| 25 | A, D, E, F, G, H, I, K, L, N, Q, R, S, T, V, W, Y | 10 | 1/17 |
| 27 | I, M, V | 1 | 1/3 |
| 28 | A | 12 | 1/1 |
| 32 | S, T | 16 | 1/2 |
| 35 | F | 1 | 1/1 |

Results

Library Construction and Phage Stock Preparation:

The new library was designed based on a set of IL-6 binding Z variants with verified binding properties (Example 4). The theoretical size of the designed library was $2.6 \times 10^7$ Z variants. The actual size of the library, determined by titration after transformation to E. coli ER2738 cells, was $1.8 \times 10^9$ transformants.

The library quality was tested by sequencing of 192 transformants and by comparing their actual sequences with the theoretical design. The contents of the actual library compared to the theoretical library were shown to be satisfying. A maturated library of potential binders to IL-6 was thus successfully constructed.

Example 6

Selection, Screening and Characterization of Z Variants from the Second Maturated Library Materials and Methods Second Phage Display Selection of Maturated IL-6 Binding Z Variants:

The target protein hIL-6 was biotinylated as described in Example 4. Phage display selections, using the second maturated library of Z variant molecules described in Example 5 were performed against hIL-6 essentially as described in Example 4, with the following exceptions. The selection volume was 4 ml in cycle 1 for all tracks. In cycle 2, selection tracks 1-2 and 1-3 were handled in one common tube and not separated until after the last 1 min wash, whereupon they were treated separately. Also in cycle 4, each set of the selection tracks 1-1-1-1 to 1-1-1-3, 1-1-1-4 to 1-1-1-6, 1-1-2-1 to 1-1-2-3 and 1-1-2-4 to 1-1-2-6, respectively, were handled in a common tube and split into three separate tubes after the last 1 min wash and thereafter treated separately using the different washing strategies outlined in Table 11. The bound phage particles were eluted using glycine-HCl, pH 2.2, as described in Example 1. The amplification of phage particles between the selection cycles was performed essentially as described in Example 1.

An overview of the selection strategy and parameters used, describing the differences in the selection tracks in terms of lowered target concentration and an increased number of washes, is shown in Table 11.

Sequencing of Potential Binders:

Individual clones from the different selection tracks were picked for sequencing. All clones subjected to the ELISA screening were sequenced. Amplification of gene fragments and sequence analysis of gene fragments were performed essentially as described in Example 1.

ELISA Screening of Z Variants:

Single colonies containing Z variants (expressed as Z variant ABD fusion proteins as described in Example 1) were randomly picked from the selected clones of the IL-6 second maturated library and cultivated as described in Example 1. Preparation of the periplasmic supernatants and ELISA screenings were performed essentially as described in Example 1 and freeze thawing was performed in 150 µl PBST 0.05% and repeated 8 times. Biotinylated hIL-6 was used at a concentration of 0.25 nM. The periplasmic fraction of the IL-6 binder Z06814 (SEQ ID NO:1512) was used in duplicate as positive control on each ELISA plate. As a negative control, periplasm containing ABD only was assayed against biotinylated hIL-6.

TABLE 11

Overview of the selection strategy for the second maturation

| Cycle | Selection track | Phage stock from library or selection track | Target concentration (nM) | Number of 1 min washes | Number of 4 h washes | Number of 4 h washes with unlabeled Z06814 | Number of overnight washes | Number of over weekend washes |
|---|---|---|---|---|---|---|---|---|
| 1 | 1 | Zlib006IL-6A.II | 50 | 5 | — | — | — | — |
| 1 | 2 | Zlib006IL-6A.II | 10 | 5 | — | — | — | — |
| 2 | 1-1 | 1 | 10 | 15 | — | — | — | — |
| 2 | 1-2 | 1 | 5 | 15 | — | — | — | — |
| 2 | 1-3 | 1 | 5 | 15 | 1 | — | — | — |
| 2 | 2-1 | 2 | 2.5 | 12 | — | — | — | — |
| 3 | 1-1-1 | 1-1 | 1 | 5 | — | 1 | — | — |
| 3 | 1-1-2 | 1-1 | 1 | 5 | — | 1 | — | — |
| 3 | 1-2-1 | 1-2 | 0.5 | 15 | — | — | — | — |
| 3 | 1-3-1 | 1-3 | 0.5 | 15 | — | — | — | — |
| 3 | 2-1-1 | 2-1 | 0.5 | 12 | — | — | — | — |
| 3 | 2-1-2 | 2-1 | 0.1 | 12 | — | — | — | — |
| 4 | 1-1-1-1 | 1-1-1 | 1 | 5 | — | 1 | — | — |
| 4 | 1-1-1-2 | 1-1-1 | 1 | 5 | — | — | 1 | — |
| 4 | 1-1-1-3 | 1-1-1 | 1 | 5 | — | — | — | 1 |
| 4 | 1-1-1-4 | 1-1-1 | 1 | 5 | — | 1 | — | — |
| 4 | 1-1-1-5 | 1-1-1 | 1 | 5 | — | — | 1 | — |
| 4 | 1-1-1-6 | 1-1-1 | 1 | 5 | — | — | — | 1 |
| 4 | 1-1-2-1 | 1-1-2 | 1 | 5 | — | 1 | — | — |
| 4 | 1-1-2-2 | 1-1-2 | 1 | 5 | — | — | 1 | — |
| 4 | 1-1-2-3 | 1-1-2 | 1 | 5 | — | — | — | 1 |
| 4 | 1-1-2-4 | 1-1-2 | 1 | 5 | — | 1 | — | — |
| 4 | 1-1-2-5 | 1-1-2 | 1 | 5 | — | — | 1 | — |
| 4 | 1-1-2-6 | 1-1-2 | 1 | 5 | — | — | — | 1 |
| 4 | 1-2-1-1 | 1-2-1 | 0.5 | 15 | — | — | — | — |
| 4 | 1-2-1-2 | 1-2-1 | 0.5 | 15 | 1 | — | — | — |
| 4 | 1-3-1-1 | 1-3-1 | 0.5 | 15 | — | — | — | — |
| 4 | 2-1-1-1 | 2-1-1 | 0.5 | 12 | — | — | — | — |
| 4 | 2-1-2-1 | 2-1-2 | 0.1 | 12 | — | — | — | — |

ELISA EC50 Analysis of IL-6 Binders:

A selection of IL-6 binders was subjected to an analysis of the response against a dilution series of biontinylated hIL-6 using ELISA as described in Example 2. Biotinylated protein was added at a concentration of 5 nM and diluted stepwise 1:3 down to 83 fM. As a background control, all Z variants were also assayed without added target protein. Periplasm samples containing the primary IL-6 binder Z06814 (SEQ ID NO:1512) as well as maturated binder Z11632 (SEQ ID NO:7) were included as positive controls. As a negative control, periplasm containing ABD only was assayed against biotinylated hIL-6. Obtained values were analyzed using Graph Pad Prism 5 and non-linear regression.

Results

Second Phage Display Selection of Maturated IL-6 Binding Z Variants:

Selection was performed in 17 parallel tracks in total, each track containing four cycles. The selection tracks differed in target concentration, selection time and wash conditions as outlined in Table 11.

Sequencing of Potential Binders:

Randomly picked clones were sequenced. Each individual Z variant was given an identification number, Z #####, as described in Example 1. In total, 707 new unique Z variant molecules were identified. The amino acid sequences of 58 residues long Z variants are listed in FIG. 1A-VV and in the sequence listing as SEQ ID NO:1-6, SEQ ID NO:8-14, SEQ ID NO:90-150 and SEQ ID NO:872-1502. The deduced IL-6 binding motifs (BM) extend from position 8 to position 36 in each sequence. The amino acid sequences of the 49 amino acid residues long polypeptides predicted to constitute the complete three-helix bundle within each of these Z variants (BMod) extend from position 7 to position 55.

ELISA Screening of Z Variants:

Clones obtained after four selection cycles were produced in 96-well plates and screened for human IL-6 binding activity using ELISA. All randomly picked clones were analyzed. 705 of the 707 unique Z variants were found to give a response of 3× the negative controls or higher (0.3-2.3 AU) against hIL-6 at a concentration of 0.25 nM. Positive signals were shown for clones originating from all selection tracks. The average response of the negative controls on the plates was 0.085 AU.

ELISA EC50 Analysis of IL-6 Binders:

A subset of Z variants was selected based on the result in the ELISA experiment described above. All Z variants exhibiting an absorbance of over 1.6 AU or a response over 1.7 after normalizing the response against the average response of the duplicate positive control Z06814 (SEQ ID NO:1512) on each plate were subjected to a target titration in ELISA format as described in Example 4. Periplasm samples with the maturated binder Z11632 (SEQ ID NO:7) as well as the primary binder Z06814 (SEQ ID NO:1512) were also assayed as positive controls. Obtained values were analyzed and their respective EC50 values were calculated (Table 12).

TABLE 12

Calculated EC50 values from ELISA titration analysis of Z variants from the second maturation as well as positive controls Z06814 and Z11632

| Z variant | SEQ ID NO | EC50 ELISA (M) |
|---|---|---|
| Z14521 | 90 | $2.3 \times 10^{-10}$ |
| Z14524 | 91 | $2.7 \times 10^{-10}$ |
| Z14525 | 92 | $2.5 \times 10^{-10}$ |
| Z14538 | 93 | $3.2 \times 10^{-10}$ |
| Z14547 | 94 | $2.5 \times 10^{-10}$ |
| Z14550 | 95 | $2.7 \times 10^{-10}$ |
| Z14551 | 96 | $2.6 \times 10^{-10}$ |
| Z14556 | 97 | $2.8 \times 10^{-10}$ |
| Z14559 | 98 | $2.3 \times 10^{-10}$ |
| Z14596 | 99 | $2.4 \times 10^{-10}$ |
| Z14609 | 100 | $3.0 \times 10^{-10}$ |
| Z14614 | 101 | $3.8 \times 10^{-10}$ |
| Z14620 | 102 | $3.1 \times 10^{-10}$ |
| Z14630 | 6 | $2.5 \times 10^{-10}$ |
| Z14634 | 103 | $2.3 \times 10^{-10}$ |
| Z14645 | 104 | $2.5 \times 10^{-10}$ |
| Z14651 | 105 | $2.4 \times 10^{-10}$ |
| Z14662 | 106 | $2.7 \times 10^{-10}$ |
| Z14673 | 107 | $2.3 \times 10^{-10}$ |
| Z14700 | 8 | $2.4 \times 10^{-10}$ |
| Z14706 | 108 | $2.3 \times 10^{-10}$ |
| Z14710 | 109 | $2.6 \times 10^{-10}$ |
| Z14712 | 9 | $2.6 \times 10^{-10}$ |
| Z14720 | 110 | $2.2 \times 10^{-10}$ |
| Z14722 | 111 | $3.2 \times 10^{-10}$ |
| Z14731 | 112 | $2.1 \times 10^{-10}$ |
| Z14746 | 113 | $2.8 \times 10^{-10}$ |
| Z14765 | 114 | $2.7 \times 10^{-10}$ |
| Z14767 | 115 | $2.4 \times 10^{-10}$ |
| Z14782 | 116 | $2.4 \times 10^{-10}$ |
| Z14783 | 117 | $2.4 \times 10^{-10}$ |
| Z14784 | 118 | $2.5 \times 10^{-10}$ |
| Z14788 | 119 | $3.0 \times 10^{-10}$ |
| Z14829 | 120 | $2.7 \times 10^{-10}$ |
| Z14861 | 4 | $2.3 \times 10^{-10}$ |
| Z14862 | 10 | $2.2 \times 10^{-10}$ |
| Z14867 | 121 | $2.6 \times 10^{-10}$ |
| Z14868 | 122 | $2.8 \times 10^{-10}$ |
| Z14878 | 123 | $2.9 \times 10^{-10}$ |
| Z14888 | 124 | $2.2 \times 10^{-10}$ |
| Z14929 | 125 | $2.1 \times 10^{-10}$ |
| Z14944 | 126 | $1.9 \times 10^{-10}$ |
| Z14976 | 1 | $1.6 \times 10^{-10}$ |
| Z14984 | 5 | $1.6 \times 10^{-10}$ |
| Z14990 | 127 | $2.5 \times 10^{-10}$ |
| Z14992 | 128 | $2.8 \times 10^{-10}$ |
| Z15003 | 129 | $3.0 \times 10^{-10}$ |
| Z15015 | 2 | $1.8 \times 10^{-10}$ |
| Z15024 | 130 | $3.1 \times 10^{-10}$ |
| Z15025 | 131 | $2.1 \times 10^{-10}$ |
| Z15031 | 132 | $2.1 \times 10^{-10}$ |
| Z15036 | 11 | $2.4 \times 10^{-10}$ |
| Z15042 | 133 | $2.2 \times 10^{-10}$ |
| Z15053 | 134 | $2.4 \times 10^{-10}$ |
| Z15057 | 135 | $2.3 \times 10^{-10}$ |
| Z15067 | 136 | $2.2 \times 10^{-10}$ |
| Z15079 | 137 | $2.1 \times 10^{-10}$ |
| Z15082 | 138 | $2.2 \times 10^{-10}$ |
| Z15097 | 139 | $2.2 \times 10^{-10}$ |
| Z15102 | 140 | $2.1 \times 10^{-10}$ |
| Z15110 | 12 | $2.0 \times 10^{-10}$ |
| Z15111 | 141 | $2.3 \times 10^{-10}$ |
| Z15117 | 142 | $2.1 \times 10^{-10}$ |
| Z15122 | 3 | $1.7 \times 10^{-10}$ |
| Z15126 | 13 | $1.5 \times 10^{-10}$ |
| Z15129 | 143 | $2.1 \times 10^{-10}$ |
| Z15140 | 144 | $2.1 \times 10^{-10}$ |
| Z15141 | 145 | $2.3 \times 10^{-10}$ |
| Z15142 | 14 | $1.6 \times 10^{-10}$ |
| Z15145 | 146 | $2.3 \times 10^{-10}$ |
| Z15151 | 147 | $1.9 \times 10^{-10}$ |
| Z15159 | 148 | $1.8 \times 10^{-10}$ |
| Z15162 | 149 | $1.8 \times 10^{-10}$ |
| Z15164 | 150 | $2.0 \times 10^{-10}$ |
| Z06814 | 1512 | $3.2 \times 10^{-10}$ |
| Z11632 | 7 | $2.5 \times 10^{-10}$ |

Example 7

Subcloning, Production and Characterization of a Subset of IL-6 Binding Z Variants In this Example, a subset of affinity-matured IL-6 binding Z variants were produced and functionally assessed by SPR, ELISA, cell-based assays and CD. SPR was used for measuring the kinetic parameters of Z variants interacting with IL-6. Competition ELISA was applied to investigate the binding mode of Z variants to human IL-6 protein. A TF-1 cell-based assay was applied to assess the ability of Z variants to block IL-6 dependent signaling. CD was used to investigate the secondary structure of the Z variants and determine their melting temperatures.

Materials and Methods

Subcloning of Z Variants into Expression Vectors:

The DNA of 14 IL-6 binding Z variants, Z11632 (SEQ ID NO:7), Z14630 (SEQ ID NO:6), Z14700 (SEQ ID NO:8), Z14712 (SEQ ID NO:9), Z14861 (SEQ ID NO:4), Z14862 (SEQ ID NO:10), Z14976 (SEQ ID NO:1), Z14984 (SEQ ID NO:5), Z15015 (SEQ ID NO:2), Z15036 (SEQ ID NO:11), Z15110 (SEQ ID NO:12), Z15122 (SEQ ID NO:3), Z15126 (SEQ ID NO:13) and Z15142 (SEQ ID NO:14), was amplified from the library vector pAY02592. The subcloning was performed as described in Example 2. The Z gene fragments were subcloned into the expression vector pAY01448 resulting in the encoded sequence MGSSHHHHHHLQ-[Z #####]-VD (SEQ ID NO: 1595).

Protein Expression and Purification Under Denatured Conditions:

*E. coli* Rosetta cells (Novagen) were transformed with plasmids containing the gene fragment of each respective IL-6 binding Z variant and cultivated at 37° C. in 100 ml of TSB-YE medium supplemented with 50 µg/ml kanamycin. Expression was induced at $OD_{600}$=0.8 by addition of IPTG at a final concentration of 1 mM and the cultures were incubated at 25° C. for another 16-20 h. The cells were harvested by centrifugation.

Protein purification was performed under denatured conditions essentially as described in Example 2. Protein concentrations were determined by measuring the absorbance at 280 nm, using the extinction coefficient of the respective protein. The purity of the IL-6 binding Z variants was analyzed by SDS-PAGE stained with Coomassie Blue.

Protein Expression and Purification Under Native Conditions:

*E. coli* BL21 (DE3) cells (NEB, cat. no. C25271) were transformed with plasmids containing gene fragments of matured variants Z11632 (SEQ ID NO:7), Z14630 (SEQ ID NO:6), Z14700 (SEQ ID NO:8), Z14712 (SEQ ID NO:9), Z14861 (SEQ ID NO:4), Z14862 (SEQ ID NO:10), Z14976 (SEQ ID NO:1), Z14984 (SEQ ID NO:5), Z15015 (SEQ ID NO:2), Z15036 (SEQ ID NO:11), Z15110 (SEQ ID NO:12), Z15122 (SEQ ID NO:3), Z15142 (SEQ ID NO:14), of the primary Z variant Z06814 (SEQ ID NO:1512), as well as of the control Z variant Z04726 (SEQ ID NO:1553). Transformed bacterial cells were cultivated at 37° C. in 1000 ml of LB medium supplemented with 50 µg/ml kanamycin. In order to induce protein expression, IPTG was added to a final concentration of 0.1 mM at $OD_{600}=0.8$ and the cultures were incubated at 25° C. for 17 h. The cells were harvested by centrifugation at 4° C. and 8000 rpm for 30 min. Supernatants were discarded and cell pellets re-suspended in 10 ml PBS. After cell disruption by sonication, cell debris was removed by centrifugation and each supernatant was applied on 2 ml Ni-NTA columns (QIAGEN, cat. no. 30410) equilibrated with 20 ml wash buffer (20 mM $NaH_2PO_4$, 10 mM NaCl, 20 mM imidazole, pH 6.0). Contaminants were removed by washing with wash buffer, and Z variants were eluted with elution buffer (20 mM $NaH_2PO_4$, 10 mM NaCl, 250 mM imidazole, pH 6.0). The eluents were subjected to purification on an ion exchange column (Life Technologies, cat. no. 4481317), and Z variants were eluted by an increasing salt concentration. Buffer solutions of eluents were then changed to PBS (10 mM $Na_2HPO_4$, 1.8 mM $KH_2PO_4$, 137 mM NaCl, 2.7 mM KCl) using a VIVASPIN 6 column (Sartorius, cat. no. VS0691). The purity of Z variants was analyzed by SDS-PAGE stained with Coomassie Blue.

ProteOn Kinetic Analysis:

Kinetic constants ($k_{on}$ and $k_{off}$) and affinities ($K_D$) for human IL-6 were determined for 6 $His_6$-tagged Z variants purified under denatured conditions. The IL-6 binding variants Z06814 (SEQ ID NO:1512), Z14861 (SEQ ID NO:4), Z014976 (SEQ ID NO:1), Z14984 (SEQ ID NO:5), Z15015 (SEQ ID NO:2), and Z15122 (SEQ ID NO:3) were diluted to 5 µg/ml in 10 mM NaAc buffer, pH 4.5, and immobilized separately on GLC chip (Bio-Rad, cat. no. 176-5011). The immobilization was performed using amine coupling chemistry according to the manufacturer's recommendations and PBST 0.05% was used as running buffer. PBST 0.05% was also used as running buffer in the kinetic experiment using a flow rate was 60 µl/min. The analyte hIL-6 was diluted in the PBST 0.05% running buffer to final concentrations of 50 nM, 12.5 nM, 3.1 nM, 0.78 nM, 0.19 nM and 0 nM and injected in triplicate for 3 min, followed by dissociation in running buffer for 90 min. After dissociation, the surfaces were regenerated with HCl supplemented with 0.05% Tween 20. Kinetic constants were calculated from the sensorgrams using a 1:1 model in Bio-Rad manager Software (Bio-Rad).

Analysis of Binding Site:

The interference of 14 maturated IL-6 binding Z variants (purified under denatured conditions) with the interaction between human gp130 (hgp130) and the hIL-6/hIL-6Rα complex was assessed as described in Example 2. The primary binder Z06814 and the hIL-6Rα binding antibody tocilizumab were included for comparison.

TF-1 Cell-Based Assay:

TF-1 cells were cultured in RPMI1640 with L-glutamine (HyClone, cat. no. SH30027) supplemented with 10% FBS (HyClone, cat. no. SH30919.03), Pen-Strep (HyClone, cat. no. 15140-163) and 2 ng/ml rhGM-CSF (R&D Systems, cat. no. 215-GM-010). Prior to use, cells were washed twice in RPMI-1640 in absence of rhGM-CSF. Cells were then counted and dispensed into a 96-well plate (Corning, cat. no. 3596) at a density of $4\times10^4$ cells per well. In separate plates, serial dilutions (concentration range 10-0.00061 nM) of Z variants (purified under native conditions), tocilizumab (Roche) and control IgG (Jackson Immunoresearch, cat. no. Jac-009-000-003) were incubated in the presence of 0.099 nM rhIL-6 (R&D Systems, cat. no. 206-IL/CF). These pre-mixtures were then transferred to wells containing TF-1 cells, which were incubated for 72 h at 37° C. in a humidified 5% $CO_2$ atmosphere. During the last four hours of incubation, 10 µl of WST (DoGen, cat. no. EZ3000) were included per well. The absorbance was measured at 450 nM using a Victor X3 plate reader (Perkin Elmer). Relative cell viability was calculated by dividing the absorbance of each well by the mean absorbance of IL-6-treated wells in each plate. The data was assessed by non-linear regression to a four-parameter dose-response curve, and the half-maximal inhibitory concentration (IC50) was determined using Graphpad Prism software.

CD Analysis:

CD analysis was performed as described in Example 2 using Z variants purified under native conditions.

Results

ProteOn Kinetic Analysis:

The interactions of 6 $His_6$-tagged IL-6-binding Z variants with human IL-6 were analyzed in a ProteOn instrument by injecting various concentrations of the hIL-6 over surfaces containing different immobilized Z variants. The ligand immobilization levels of the surfaces were between 100-220 RU each. A summary of the kinetic parameters ($K_D$, $k_a$ ($k_{on}$) and $k_d$ ($k_{off}$)) for binding of hIL-6 to the Z variants using a 1:1 interaction model is given in Table 13.

TABLE 13

Kinetic parameters for binding of hIL-6 to Z variants

| Z variant | SEQ ID NO: | $k_{on}$ ($M^{-1}s^{-1}$) | $k_{off}$ ($s^{-1}$) | $K_D$ (M) |
|---|---|---|---|---|
| $His_6$-Z06814 | 1512 | $4.3 \times 10^5$ | $8.8 \times 10^{-5}$ | $2.0 \times 10^{-10}$ |
| $His_6$-Z14861 | 4 | $3.6 \times 10^5$ | $6.3 \times 10^{-5}$ | $1.7 \times 10^{-10}$ |
| $His_6$-Z14976 | 1 | $3.1 \times 10^5$ | $2.7 \times 10^{-5}$ | $8.8 \times 10^{-11}$ |
| $His_6$-Z14984 | 5 | $3.0 \times 10^5$ | $7.4 \times 10^{-5}$ | $2.5 \times 10^{-10}$ |
| $His_6$-Z15015 | 2 | $4.3 \times 10^5$ | $7.2 \times 10^{-5}$ | $1.7 \times 10^{-10}$ |
| $His_6$-Z15122 | 3 | $3.1 \times 10^5$ | $3.9 \times 10^{-5}$ | $1.2 \times 10^{-10}$ |

Figure 5:
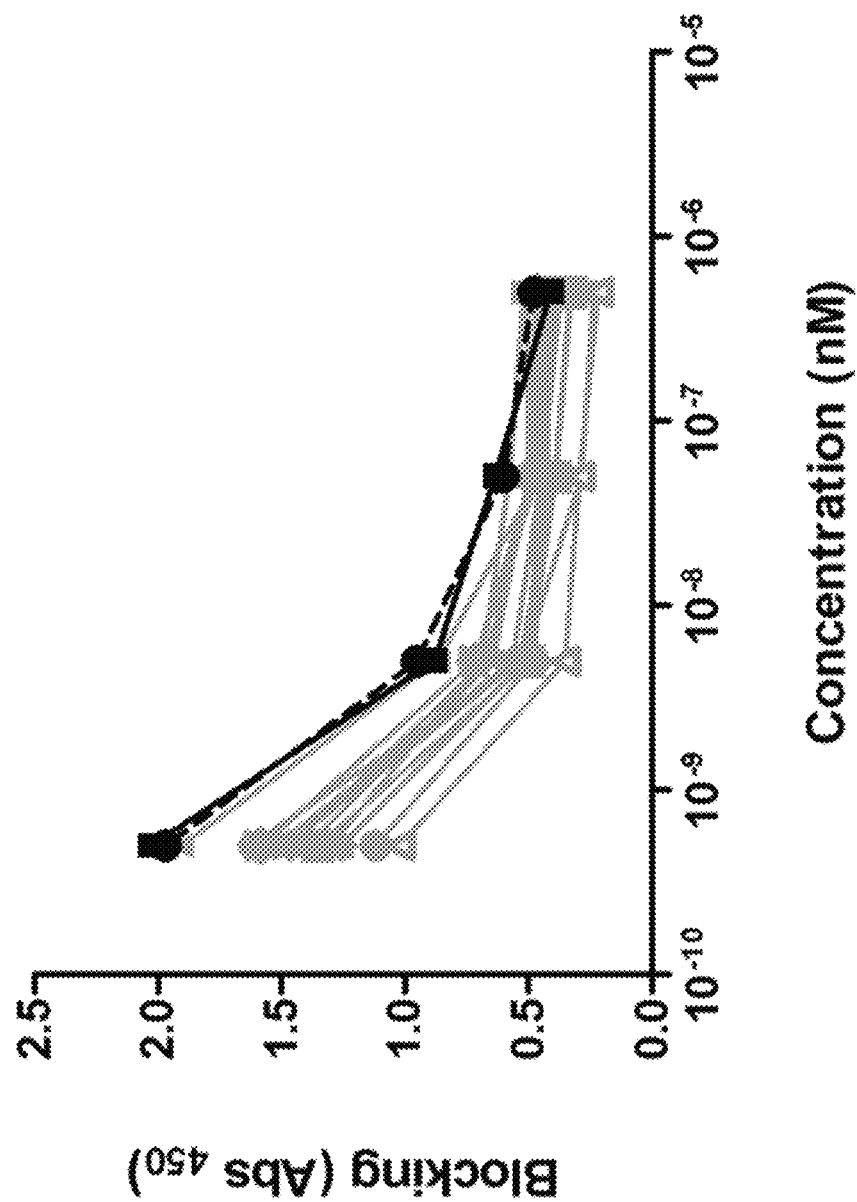
FIG. 5 shows the result of blocking of the binding of the hIL-6/hIL-6Rα complex to hgp130, assayed as described in Example 7. Concentration dependent blocking was seen for all tested maturated IL-6 binding Z variants (gray) as well as for tocilizumab (black) and the primary binder Z06814 (SEQ ID NO:1512, broken line), which were both included for comparison. All maturated IL-6 binding Z variants showed more efficient blocking than the primary binders assayed in Example 2 (compare FIG. 3).

Analysis of Binding Site:

All maturated IL-6 binding Z variants showed a clear concentration-dependent blocking of the trans-signaling resembling interaction between preformed hIL-6/hIL-6Rα complexes and hgp130 (FIG. 5). Each maturated Z variant showed a higher blocking capacity than both the primary binder Z06814 and tocilizumab, i.e. which would correspond to IC50 values less than 1.6 nM.

Figure 6:
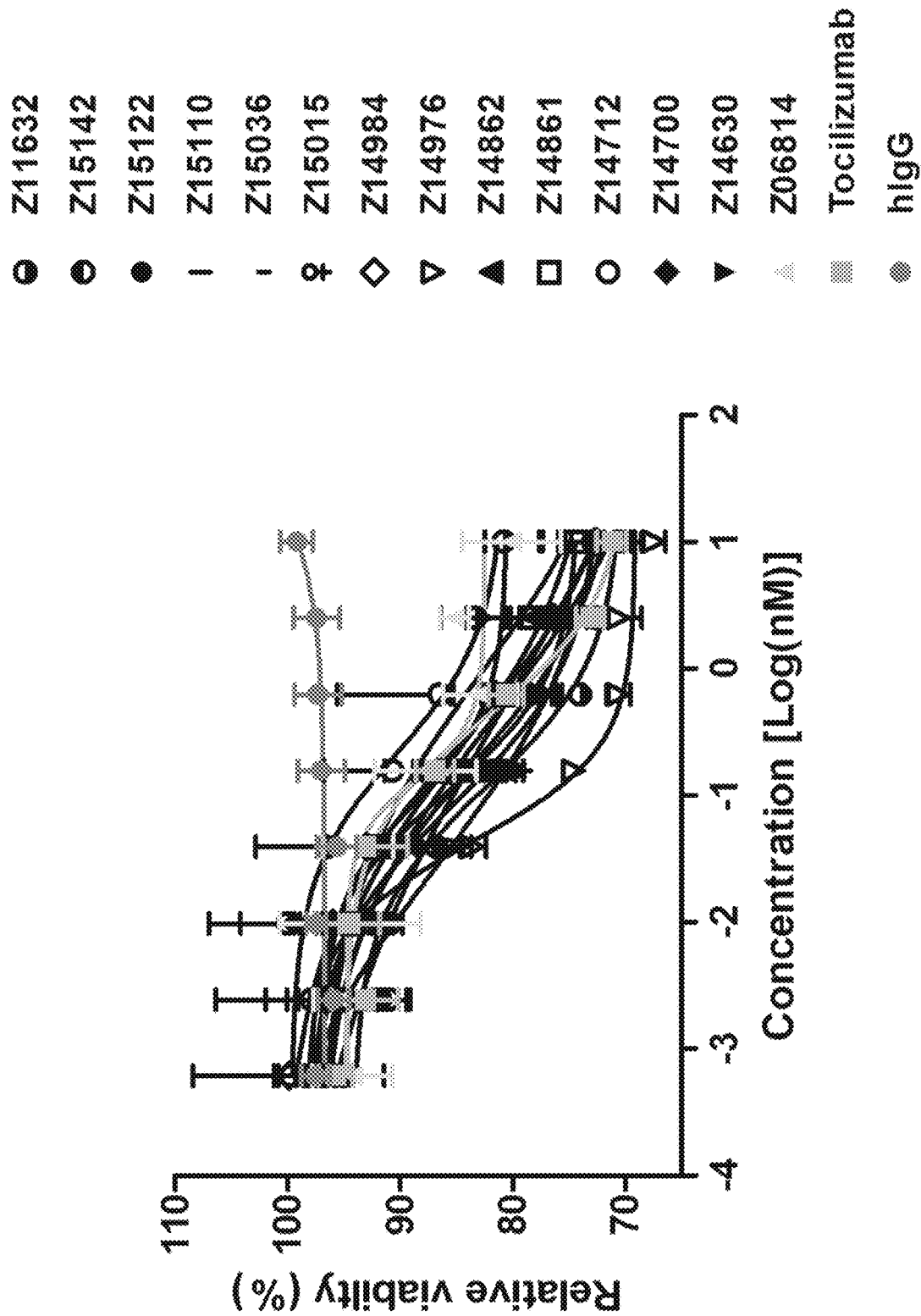
FIG. 6 shows the result of the TF-1 cell neutralizing assay described in Example 7. Concentration dependent inhibition of IL-6 induced TF-1 cell proliferation was seen for all tested IL-6 binding Z variants (matured Z variants shown in black; primary binder Z06814 (SEQ ID NO:1512) shown as grey filled triangles) and for tocilizumab (grey filled squares), but not for the negative control antibody hIgG (grey filled circles).

TF-1 Cell-Based Assay:

A TF-1 cell-based assay was conducted to evaluate the efficacy and potency of IL-6 binding Z variants in the classical signaling pathway. This assay showed that all affinity-matured IL-6 binding Z variants were capable of blocking IL-6 dependent growth of the TF-1 cells (FIG. 6). The calculated IC50 values for Z variants and for the hIL-6Rα binding antibody tocilizumab are shown in Table 14.

TABLE 14

IC50 values for matured Z variants blocking the IL-6 dependent growth of TF-1 cells

| Z variant | SEQ ID NO: | IC50 (M) |
|---|---|---|
| $His_6$-Z11632 | 7 | $1.2 \times 10^{-10}$ |
| $His_6$-Z14630 | 6 | $8.7 \times 10^{-11}$ |
| $His_6$-Z14700 | 8 | $1.0 \times 10^{-10}$ |
| $His_6$-Z14712 | 9 | $2.2 \times 10^{-10}$ |
| $His_6$-Z14861 | 4 | $1.9 \times 10^{-10}$ |
| $His_6$-Z14862 | 10 | $4.3 \times 10^{-10}$ |
| $His_6$-Z14976 | 1 | $4.2 \times 10^{-11}$ |

TABLE 14-continued

IC50 values for matured Z variants blocking
the IL-6 dependent growth of TF-1 cells

| Z variant | SEQ ID NO: | IC50 (M) |
|---|---|---|
| His$_6$-Z14984 | 5 | $2.7 \times 10^{-10}$ |
| His$_6$-Z15015 | 2 | $2.7 \times 10^{-11}$ |
| His$_6$-Z15036 | 11 | $1.8 \times 10^{-10}$ |
| His$_6$-Z15110 | 12 | $9.3 \times 10^{-10}$ |
| His$_6$-Z15122 | 3 | $8.5 \times 10^{-11}$ |
| His$_6$-Z15142 | 14 | $5.1 \times 10^{-10}$ |
| His$_6$-Z06814 | 1512 | $1.3 \times 10^{-10}$ |
| tocilizumab | N/A | $4.1 \times 10^{-10}$ |

CD Analysis:

The CD spectra determined for 10 matured Z variants showed that each one had an α-helical structure at 20° C. The melting temperatures (Tm) determined by variable temperature measurement are shown in Table 15.

TABLE 15

Melting temperatures for a subset of matured Z variants

| Z variant | SEQ ID NO: | Tm (° C.) |
|---|---|---|
| His$_6$-Z11632 | 7 | 51 |
| His$_6$-Z14630 | 6 | 57 |
| His$_6$-Z14700 | 8 | 53 |
| His$_6$-Z14712 | 9 | 55 |
| His$_6$-Z14861 | 4 | 48 |
| His$_6$-Z14862 | 10 | 53 |
| His$_6$-Z15015 | 2 | 56 |
| His$_6$-Z15036 | 11 | 59 |
| His$_6$-Z15110 | 12 | 50 |
| His$_6$-Z15142 | 14 | 53 |

Example 8

In Vivo Activity of IL-6 Binding Z Variants in Fusion with ABD

A Serum Amyloid A (SAA) mouse model was used in order to explore the in vivo blocking effect of the IL-6 binding Z variants in fusion with ABD. The acute phase protein SAA is secreted from liver cells and can be induced by the proinflammatory cytokines IL-1, IL-6 and TNF. Due to the sequence homology of the human and mouse cytokines, the human variants are able to act on their corresponding mouse receptors and induce a murine SAA response. Note, that the human TNF protein is only able to interact with murine TNFRII (not murine TNFRI).

Materials and Methods

The IL-6 targeting Z variant Z06814 (SEQ ID NO:1512) and a control Z variant Z04726 (SEQ ID NO:1535) binding an irrelevant target, were cloned and produced in fusion with the ABD variant PP013 (SEQ ID NO:1554) as described in Example 2. Four groups of Balb/c mice (n=8) were injected subcutaneously (s.c.) with various doses (0, 0.025, 2.5 or 25 mg/kg body weight) of Z06814-ABD 9 h prior to intraperitoneal (i.p.) administration of hIL-6 at 5 μg/kg (R&D Systems). A fifth group of mice (n=8) received 25 mg/kg of Z04726-ABD. Two additional control groups of mice received PBS (n=4) and 25 mg/kg of Z06814-ABD (n=8), respectively, but no subsequent IL-6 injection. After 20 h, the blood was taken by cardiac puncture and serum was collected.

Serum was assessed for the content of murine SAA by ELISA (Tridelta) according to the manufacturer's instructions. In brief, diluted serum samples were added to SAA-precoated plates together with anti-SAA-HRP. The plates were incubated for 1 h and then washed four times. TMB substrate was added for 20 min and the reaction was stopped with stop solution. The absorbance was measured at 450 nm using a microplate reader (Victor³, Perkin Elmer).

Results

Figure 7:
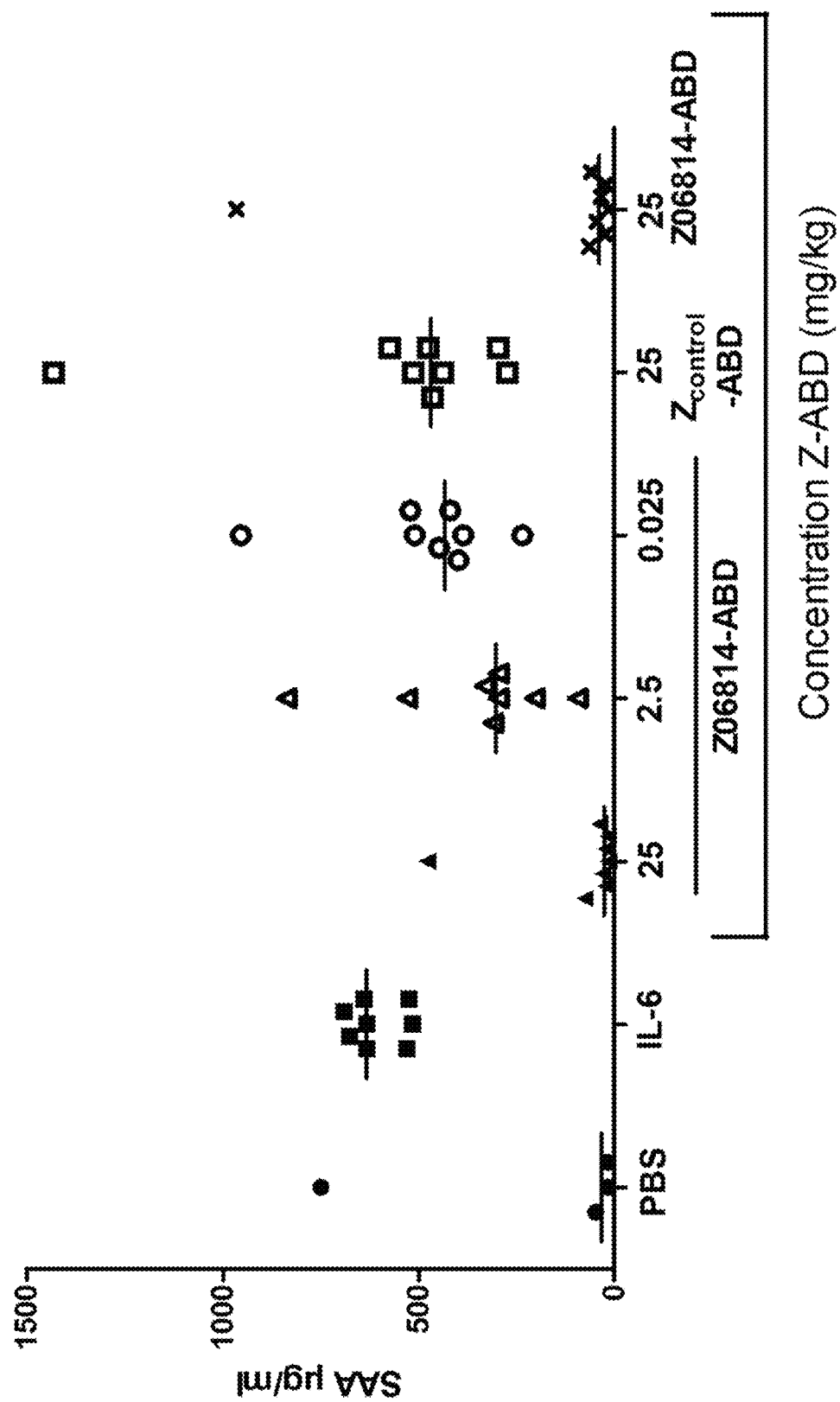
FIG. 7 shows the in vivo efficacy of the Z variant Z06814 (SEQ ID NO:1512) in fusion with the ABD variant PP013 (SEQ ID NO:1554) as scored by assaying IL-6 triggered serum amyloid-A (SAA) protein release in an anti-arthritic mouse model as described in Example 8. Four groups of mice were given 0 (filled squares), 0.025 (open dots), 2.5 (open triangles) or 25 (closed triangles) mg/kg body weight of the IL-6 binding Z06814-ABD fusion protein. As a control, mice were given 25 mg/kg of a control Z variant (Z04726; SEQ ID NO:1553) in fusion with ABD (referred to as $Z_{control}$-ABD) (open squares). Mice were injected with hIL-6 and subsequently the levels of SAA protein were measured. Two additional control groups of mice received PBS (filled circles) and 25 mg/kg Z06814-ABD (crosses), respectively, but no subsequent IL-6 injection.

The anti-arthritic efficacy of the Z variant Z06814 (SEQ ID NO:1512) was assessed in vivo using a mouse model for IL-6 triggered serum amyloid-A (SAA) protein release. Four groups of mice were given 0, 0.025, 2.5 or 25 mg/kg body weight of the IL-6 binding Z06814-ABD fusion protein or 25 mg/kg of a control Z04726-ABD fusion protein 9 h before an injection of 5 μg/kg body weight of hIL-6. After an additional 22 h, the levels of SAA protein were measured and compared between the different groups. In animals receiving either no Z06814-ABD or 25 mg/kg of the control Z04726-ABD fusion, SAA protein levels in serum increased to levels of approximately 500-600 μg/ml. Control animals given PBS only (and no hIL-6) exhibited levels in the range of 16-64 μg/ml. In animals given Z06814-ABD, significantly lower SAA protein levels were measured in a dose-dependent manner (FIG. 7). For the group given the highest dose of Z06814-ABD (25 mg/kg body weight), SAA protein levels were as low as for animals given no hIL-6 injection.

ITEMIZED LISTING OF EMBODIMENTS

1. IL-6 binding polypeptide, comprising an IL-6 binding motif BM, which motif consists of an amino acid sequence selected from:

(SEQ ID NO: 1562)
i) EEX$_3$X$_4$AWX$_7$EIHX$_{11}$LPNLX$_{16}$X$_{17}$X$_{18}$QX$_{20}$X$_{21}$AFIX$_{25}$X$_{26}$LX$_{28}$X$_{29}$ wherein, independently from each other, X$_3$ is selected from A, F, H, K, Q, R, S, W and Y;
X$_4$ is selected from A, D, E, F, H, I, K, L, M, N, Q, R, S, T, V and Y;
X$_7$ is selected from F, H, I, K, L, M, N, R, S, T, V, W and Y;
X$_{11}$ is selected from A, I, K, L, M, N, R, S, T and V;
X$_{16}$ is selected from N and T;
X$_{17}$ is selected from A, I, T and V;
X$_{18}$ is selected from D, E, G, H, K, N, Q, R, S and T;
X$_{20}$ is selected from I, L, M, R, T and V;
X$_{21}$ is selected from A, S, T and V;
X$_{25}$ is selected from I, M, Q, S, T, V and W;
X$_{26}$ is selected from K and S;
X$_{28}$ is selected from F, L, M and Y; and
X$_{29}$ is selected from D and R;

and ii) an amino acid sequence which has at least 93% identity to the sequence defined in i).

2. IL-6 binding polypeptide according to item 1, wherein in sequence i):

X$_3$ is selected from A, H, K, Q, R and Y;
X$_4$ is selected from A, D, E, F, H, I, K, L, M, N, Q, R, S, T, V and Y;
X$_7$ is selected from F, H, I, K, L, M, N, R, T, V, W and Y;
X$_{11}$ is selected from A, I, K, L, N, S, T and V;
X$_{16}$ is T;
X$_{17}$ is selected from A, I, T and V;
X$_{18}$ is selected from D, E, H, K, N, Q, R, S and T;
X$_{20}$ is selected from I, L, M, R and V;
X$_{21}$ is selected from A, S and V;

$X_{25}$ is selected from I, Q, S, T, V and W;
$X_{26}$ is K;
$X_{28}$ is selected from F, L, M and Y; and
$X_{29}$ is D.

3. IL-6 binding polypeptide according to item 1 or 2, wherein sequence i) fulfills at least six of the eleven conditions I-XI:
I. $X_3$ is selected from K and R;
II. $X_{11}$ is selected from A and L;
III. $X_{16}$ is T;
IV. $X_{17}$ is selected from I and V;
V. $X_{18}$ is selected from D and E;
VI. $X_{20}$ is M;
VII. $X_{21}$ is A;
VIII. $X_{25}$ is selected from S and T;
IX. $X_{26}$ is K;
X. $X_{28}$ is F; and
XI. $X_{29}$ is D.

4. IL-6 binding polypeptide according to item 3, wherein sequence i) fulfills at least seven of the eleven conditions I-XI.

5. IL-6 binding polypeptide according to item 4, wherein sequence i) fulfills at least eight of the eleven conditions I-XI.

6. IL-6 binding polypeptide according to item 5, wherein sequence i) fulfills at least nine of the eleven conditions I-XI.

7. IL-6 binding polypeptide according to item 6, wherein sequence i) fulfills at least ten of the eleven conditions I-XI.

8. IL-6 binding polypeptide according to item 7, wherein sequence i) fulfills all of the eleven conditions I-XI.

9. IL-6 binding polypeptide according to any preceding item, wherein $X_{17}X_{20}X_{21}$ is selected from VMA and IMA.

10. IL-6 binding polypeptide according to any one of items 1-8, wherein $X_{20}X_{21}X_{28}$ is MAF.

11. IL-6 binding polypeptide according to any one of items 1-8, wherein $X_{17}X_{20}X_{28}$ is selected from VMF and IMF.

12. IL-6 binding polypeptide according to any one of items 1-8, wherein $X_{17}X_{21}X_{28}$ is selected from VAF and IAF.

13. IL-6 binding polypeptide according to any preceding item, wherein sequence i) corresponds to the sequence from position 8 to position 36 in a sequence selected from the group consisting of SEQ ID NO:1-1551.

14. IL-6 binding polypeptide according to item 13, wherein sequence i) corresponds to the sequence from position 8 to position 36 in a sequence selected from the group consisting of SEQ ID NO:1-1502.

15. IL-6 binding polypeptide according to item 14, wherein sequence i) corresponds to the sequence from position 8 to position 36 in a sequence selected from the group consisting of SEQ ID NO:7, SEQ ID NO:15-89 and SEQ ID NO:151-871.

16. IL-6 binding polypeptide according to item 14, wherein sequence i) corresponds to the sequence from position 8 to position 36 in a sequence selected from the group consisting of SEQ ID NO:1-6, SEQ ID NO:8-14, SEQ ID NO:90-150 and SEQ ID NO:872-1502.

17. IL-6 binding polypeptide according to item 13, wherein sequence i) corresponds to the sequence from position 8 to position 36 in a sequence selected from the group consisting of SEQ ID NO:1-152 and SEQ ID NO:1503-1515.

18. IL-6 binding polypeptide according to item 17, wherein sequence i) corresponds to the sequence from position 8 to position 36 in a sequence selected from the group consisting of SEQ ID NO:1-150 and SEQ ID NO:1503-1515.

19. IL-6 binding polypeptide according to item 17, wherein sequence i) corresponds to the sequence from position 8 to position 36 in a sequence selected from the group consisting of SEQ ID NO:1-152.

20. IL-6 binding polypeptide according to item 18 or 19, wherein sequence i) corresponds to the sequence from position 8 to position 36 in a sequence selected from the group consisting of SEQ ID NO:1-150.

21. IL-6 binding polypeptide according to item 19, wherein sequence i) corresponds to the sequence from position 8 to position 36 in a sequence selected from the group consisting of SEQ ID NO:7, SEQ ID NO:15-89 and SEQ ID NO:151-152.

22. IL-6 binding polypeptide according to item 20, wherein sequence i) corresponds to the sequence from position 8 to position 36 in a sequence selected from the group consisting of SEQ ID NO:1-6, SEQ ID NO:8-14 and SEQ ID NO:90-150.

23. IL-6 binding polypeptide according to item 18, wherein sequence i) corresponds to the sequence from position 8 to position 36 in a sequence selected from the group consisting of SEQ ID NO:1-14 and SEQ ID NO:1503-1515.

24. IL-6 binding polypeptide according to item 23, wherein sequence i) corresponds to the sequence from position 8 to position 36 in a sequence selected from the group consisting of SEQ ID NO:1-14 and SEQ ID NO:1512.

25. IL-6 binding polypeptide according to item 24, wherein sequence i) corresponds to the sequence from position 8 to position 36 in a sequence selected from the group consisting of SEQ ID NO:1-14.

26. IL-6 binding polypeptide according to any one of items 16, 22 and 25, wherein sequence i corresponds to the sequence from position 8 to position 36 in a sequence selected from the group consisting of SEQ ID NO:1-5.

27. IL-6 binding polypeptide according to item 24, wherein sequence i) corresponds to the sequence from position 8 to position 36 in SEQ ID NO:1512.

28. IL-6 binding polypeptide according to any preceding item, wherein said IL-6 binding motif forms part of a three-helix bundle protein domain.

29. IL-6 binding polypeptide according to item 28, wherein said IL-6 binding motif essentially forms part of two helices with an interconnecting loop, within said three-helix bundle protein domain.

30. IL-6 binding polypeptide according to item 29, wherein said three-helix bundle protein domain is selected from bacterial receptor domains.

31. IL-6 binding polypeptide according to item 30, wherein said three-helix bundle protein domain is selected from domains of protein A from *Staphylococcus aureus* or derivatives thereof.

32. IL-6 binding polypeptide according to any preceding item, which comprises a binding module BMod, the amino acid sequence of which is selected from:

(SEQ ID NO: 1563)
iii) K-[BM]-DPSQSX$_a$X$_b$LLX$_c$EAKKLX$_d$X$_e$X$_f$Q;

wherein
[BM] is an IL-6 binding motif as defined in any one of items 1-27
provided that $X_{29}$ is D;

$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S; and
iv) an amino acid sequence which has at least 91% identity to a sequence defined by iii).

33. IL-6 binding polypeptide according to any one of items 1-31, which comprises a binding module BMod, the amino acid sequence of which is selected from:

(SEQ ID NO: 1564)
v) K-[BM]-QPEQSX$_a$X$_b$LLX$_c$EAKKLX$_d$X$_e$X$_f$Q, wherein
[BM] is an IL-6 binding motif as defined in any one of items 1-27
provided that $X_{29}$ is R;
$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S; and
vi) an amino acid sequence which has at least 91% identity to a sequence defined by v).

34. IL-6 binding polypeptide according to any one of items 1-32, wherein sequence iii) corresponds to the sequence from position 7 to position 55 in a sequence selected from the group consisting of SEQ ID NO:1-1551.

35. IL-6 binding polypeptide according to item 34, wherein sequence iii) corresponds to the sequence from position 7 to position 55 in a sequence selected from the group consisting of SEQ ID NO:1-1502.

36. IL-6 binding polypeptide according to item 35, wherein sequence iii) corresponds to the sequence from position 7 to position 55 in a sequence selected from the group consisting of SEQ ID NO:7, SEQ ID NO:15-89 and SEQ ID NO:151-871.

37. IL-6 binding polypeptide according to item 35, wherein sequence iii) corresponds to the sequence from position 7 to position 55 in a sequence selected from the group consisting of SEQ ID NO:1-6, SEQ ID NO:8-14, SEQ ID NO:90-150 and SEQ ID NO:872-1502.

38. IL-6 binding polypeptide according to item 34, wherein sequence iii) corresponds to the sequence from position 7 to position 55 in a sequence selected from the group consisting of SEQ ID NO:1-152 and SEQ ID NO:1503-1515.

39. IL-6 binding polypeptide according to item 38, wherein sequence iii) corresponds to the sequence from position 7 to position 55 in a sequence selected from the group consisting of SEQ ID NO:1-150 and SEQ ID NO:1503-1515.

40. IL-6 binding polypeptide according to item 35 or 38, wherein sequence iii) corresponds to the sequence from position 7 to position 55 in a sequence selected from the group consisting of SEQ ID NO:1-152.

41. IL-6 binding polypeptide according to item 39 or 40, wherein sequence iii) corresponds to the sequence from position 7 to position 55 in a sequence selected from the group consisting of SEQ ID NO:1-150.

42. IL-6 binding polypeptide according to item 40, wherein sequence iii) corresponds to the sequence from position 7 to position 55 in a sequence selected from the group consisting of SEQ ID NO:7, SEQ ID NO:15-89 and SEQ ID NO:151-152.

43. IL-6 binding polypeptide according to item 41, wherein sequence iii) corresponds to the sequence from position 7 to position 55 in a sequence selected from the group consisting of SEQ ID NO:1-6, SEQ ID NO:8-14 and SEQ ID NO:90-150.

44. IL-6 binding polypeptide according to item 39, wherein sequence iii) corresponds to the sequence from position 7 to position 55 in a sequence selected from the group consisting of SEQ ID NO:1-14 and SEQ ID NO:1503-1515.

45. IL-6 binding polypeptide according to item 44, wherein sequence iii) corresponds to the sequence from position 7 to position 55 in a sequence selected from the group consisting of SEQ ID NO:1-14 and SEQ ID NO:1512.

46. IL-6 binding polypeptide according to item 45, wherein sequence iii) corresponds to the sequence from position 7 to position 55 in a sequence selected from the group consisting of SEQ ID NO:1-14.

47. IL-6 binding polypeptide according to any one of items 37, 43 and 46, wherein sequence iii) corresponds to the sequence from position 7 to position 55 in a sequence selected from the group consisting of SEQ ID NO:1-5.

48. IL-6 binding polypeptide according to item 45, wherein sequence iii) corresponds to the sequence from position 7 to position 55 in SEQ ID NO:1512.

49. IL-6 binding polypeptide according to any preceding item, which comprises an amino acid sequence selected from:
vii) YA-[BMod]-AP,
wherein [BMod] is an IL-6 binding module as defined in any one of items 32-48; and
viii) an amino acid sequence which has at least 90% identity to a sequence defined by vii).

50. IL-6 binding polypeptide according to any one of items 1-48, which comprises an amino acid sequence selected from:
ix) FN-[BMod]-AP;
wherein [BMod] is an IL-6 binding module as defined in any one of items 32-48; and
x) an amino acid sequence which has at least 90% identity to a sequence defined by ix).

51. IL-6 binding polypeptide according to any preceding item, which comprises an amino acid sequence selected from:

ADNNFNK-[BM]-DPSQSANLLSEAKKLNESQAPK;

ADNKFNK-[BM]-DPSQSANLLAEAKKLNDAQAPK;

ADNKFNK-[BM]-DPSVSKEILAEAKKLNDAQAPK;

ADAQQNNFNK-[BM]-DPSQSTNVLGEAKKLNESQAPK;

AQHDE-[BM]-DPSQSANVLGEAQKLNDSQAPK;

VDNKFNK-[BM]-DPSQSANLLAEAKKLNDAQAPK;

AEAKYAK-[BM]-DPSESSELLSEAKKLNKSQAPK;

VDAKYAK-[BM]-DPSQSSELLAEAKKLNDAQAPK;

VDAKYAK-[BM]-DPSQSSELLAEAKKLNDSQAPK;

AEAKYAK-[BM]-DPSQSSELLSEAKKLNDSQAPK;

AEAKYAK-[BM]-DPSQSSELLSEAKKLSESQAPK;

AEAKYAK-[BM]-QPEQSSELLSEAKKLSESQAPK;

AEAKYAK-[BM]-DPSQSSELLSEAKKLESSQAPK;

AEAKYAK-[BM]-QPEQSSELLSEAKKLESSQAPK;

VDAKYAK-[BM]-DPSQSSELLSEAKKLNDSQAPK;

VDAKYAK-[BM]-DPSQSSELLSEAKKLSESQAPK;

VDAKYAK-[BM]-QPEQSSELLSEAKKLSESQAPK;

VDAKYAK-[BM]-DPSQSSELLSEAKKLESSQAPK;

VDAKYAK-[BM]-QPEQSSELLSEAKKLESSQAPK;

VDAKYAK-[BM]-DPSQSSELLAEAKKLNKAQAPK;
and

AEAKYAK-[BM]-DPSQSSELLAEAKKLNKAQAPK;

wherein [BM] is an IL-6 binding motif as defined in any one of items 1-27.

52. IL-6 binding polypeptide according to any one of items 1-49, which comprises an amino acid sequence selected from:

xi) VDAKYAK-[BM]-DPSQSSELLSEAKKLNDSQAPK;

wherein [BM] is an IL-6 binding motif as defined in any one of items 1-27; and xii) an amino acid sequence which has at least 89% identity to the sequence defined in xi).

53. IL-6 binding polypeptide according to any one of items 1-49, which comprises an amino acid sequence selected from:

xiii) AEAKYAK-[BM]-DPSQSSELLSEAKKLNDSQAPK;

wherein [BM] is an IL-6 binding motif as defined in any one of items 1-27; and xiv) an amino acid sequence which has at least 89% identity to the sequence defined in xiii).

54. IL-6 binding polypeptide according to item 52, wherein sequence xi) is selected from the group consisting of SEQ ID NO:1-1551.

55. IL-6 binding polypeptide according to item 54, wherein sequence xi) is selected from the group consisting of SEQ ID NO:1-1502.

56. IL-6 binding polypeptide according to item 55, wherein sequence xi) is selected from the group consisting of SEQ ID NO:7, SEQ ID NO:15-89 and SEQ ID NO:151-871.

57. IL-6 binding polypeptide according to item 55, wherein sequence xi) is selected from the group consisting of SEQ ID NO:1-6, SEQ ID NO:8-14, SEQ ID NO:90-150 and SEQ ID NO:872-1502.

58. IL-6 binding polypeptide according to item 54, wherein sequence xi) is selected from the group consisting of SEQ ID NO:1-152 and SEQ ID NO:1503-1515.

59. IL-6 binding polypeptide according to item 58, wherein sequence xi) is selected from the group consisting of SEQ ID NO:1-150 and SEQ ID NO:1503-1515.

60. IL-6 binding polypeptide according to item 55 or 58, wherein sequence xi) is selected from the group consisting of SEQ ID NO:1-152.

61. IL-6 binding polypeptide according to item 59 or 60, wherein sequence xi) is selected from the group consisting of SEQ ID NO:1-150.

62. IL-6 binding polypeptide according to item 60, wherein sequence xi) is selected from the group consisting of SEQ ID NO:7, SEQ ID NO:15-89 and SEQ ID NO:151-152.

63. IL-6 binding polypeptide according to item 61, wherein sequence xi) is selected from the group consisting of SEQ ID NO:1-6, SEQ ID NO:8-14 and SEQ ID NO:90-150.

64. IL-6 binding polypeptide according to item 59, wherein sequence xi) is selected from the group consisting of SEQ ID NO:1-14 and SEQ ID NO:1503-1515.

65. IL-6 binding polypeptide according to item 64, wherein sequence xi) is selected from the group consisting of SEQ ID NO:1-14 and SEQ ID NO:1512.

66. IL-6 binding polypeptide according to item 65, wherein sequence xi) is selected from the group consisting of SEQ ID NO:1-14.

67. IL-6 binding polypeptide according to any one of items 57, 63 and 66, wherein sequence xi) is selected from the group consisting of SEQ ID NO:1-5.

68. IL-6 binding polypeptide according to item 65, wherein sequence xi) is SEQ ID NO:1512.

69. IL-6 binding polypeptide according to any preceding item, which is capable of blocking the IL-6 dependent signaling via the cis-signaling pathway and/or the trans-signaling pathway.

70. IL-6 binding polypeptide according to item 69, wherein the half maximal inhibitory concentration (IC50) of the blocking is at most $1\times10^{-6}$ M, such as at most $1\times10^{-7}$ M, such as at most $1\times10^{-8}$ M, such as at most $1\times10^{-9}$ M, such as at most $1\times10^{-10}$ M.

71. IL-6 binding polypeptide according to item 69 or 70, which is capable of blocking the interaction of IL-6/IL-6Rα with gp130.

72. IL-6 binding polypeptide according to any preceding item, which is capable of binding to IL-6 such that the EC50 value of the interaction is at most $1\times10^{-7}$ M, such as at most $1\times10^{-8}$ M, such as at most $1\times10^{-9}$ M, such as at most $1\times10^{-10}$ M.

73. IL-6 binding polypeptide according to any preceding item, which is capable of binding to IL-6 such that the $K_D$ value of the interaction is at most $1\times10^{-8}$ M, such as at most $1\times10^{-9}$ M, such as at most $1\times10^{-10}$ M.

74. IL-6 binding polypeptide according to any preceding item which comprises additional amino acids at the C-terminal and/or N-terminal end.

75. IL-6 binding polypeptide according to item 74, wherein said additional amino acid(s) improve(s) production, purification, stabilization in vivo or in vitro, coupling or detection of the polypeptide.

76. IL-6 binding polypeptide according to any preceding item in multimeric form, comprising at least two IL-6 binding polypeptide monomer units, whose amino acid sequences may be the same or different.

77. IL-6 binding polypeptide according to item 76, wherein said IL-6 binding polypeptide monomer units are covalently coupled together.

78. IL-6 binding polypeptide according to item 77, wherein the IL-6 binding polypeptide monomer units are expressed as a fusion protein.

79. IL-6 binding polypeptide according to item 78, in dimeric form.

80. Fusion protein or conjugate comprising
a first moiety consisting of an IL-6 binding polypeptide according to any preceding item; and
a second moiety consisting of a polypeptide having a desired biological activity.

81. Fusion protein or conjugate according to item 80, wherein said desired biological activity is a therapeutic activity.

82. Fusion protein or conjugate according to item 80, wherein said desired biological activity is a binding activity.

83. Fusion protein or conjugate according to item 82, wherein said binding activity is albumin binding activity which increases in vivo half-life of the fusion protein or conjugate.

84. Fusion protein or conjugate according to item 83, wherein said second moiety comprises the albumin binding domain of streptococcal protein G or a derivative thereof.

85. Fusion protein or conjugate according to item 82, wherein said binding activity acts to block a biological activity.

86. Fusion protein or conjugate according to item 80, wherein said desired biological activity is an enzymatic activity.

87. Fusion protein or conjugate according to item 81, wherein the second moiety is a therapeutically active polypeptide.

88. Fusion protein or conjugate according to item 87, wherein the second moiety is an immune response modifying agent.

89. Fusion protein or conjugate according to item 87, wherein the second moiety is an anti-cancer agent.

90. Fusion protein or conjugate according to any one of items 80, 81, 86, 88 and 89, wherein the second moiety is selected from the group consisting of human endogenous enzymes, hormones, growth factors, chemokines, cytokines and lymphokines.

91. IL-6 binding polypeptide, fusion protein or conjugate according to any preceding item, further comprising a label.

92. IL-6 binding polypeptide, fusion protein or conjugate according to item 91, wherein said label is selected from the group consisting of fluorescent dyes and metals, chromophoric dyes, chemiluminescent compounds and bioluminescent proteins, enzymes, radionuclides and radioactive particles.

93. IL-6 binding polypeptide, fusion protein or conjugate according to any preceding item, comprising a chelating environment provided by a polyaminopolycarboxylate chelator conjugated to the IL-6 binding polypeptide via a thiol group of a cysteine residue or an amine group of a lysine residue.

94. A polynucleotide encoding a polypeptide according to any one of items 1-79.

95. Expression vector comprising a polynucleotide according to item 94.

96. Host cell comprising an expression vector according to item 95.

97. Method of producing a polypeptide according to any one of items 1-79, comprising
culturing a host cell according to item 96 under conditions permissive of expression of said polypeptide from said expression vector, and
isolating said polypeptide.

98. Composition comprising an IL-6 binding polypeptide, fusion protein or conjugate according to any one of items 1-93 and at least one pharmaceutically acceptable excipient or carrier.

99. Composition according to item 98, further comprising at least one additional active agent, such as an agent selected from an immune response modifying agent and an anti-cancer agent.

100. IL-6 binding polypeptide, fusion protein or conjugate according to any one of items 1-93 or a composition according to any one of items 98-99 for oral, topical, intravenous, intraperitoneal, subcutaneous, pulmonary, transdermal, intramuscular, intranasal, buccal, sublingual or suppository administration, such as for topical administration.

101. IL-6 binding polypeptide, fusion protein or conjugate according to any one of items 1-93 or a composition according to any one of items 98-99 for use as a medicament, a diagnostic agent or a prognostic agent.

102. IL-6 binding polypeptide, fusion protein or conjugate according to any one of items 1-93 or a composition according to any one of items 98-99 for use as a medicament.

103. IL-6 binding polypeptide, fusion protein, conjugate or composition for use according to item 102, wherein said polypeptide, fusion protein, conjugate or composition modulates IL-6 function in vivo.

104. IL-6 binding polypeptide, fusion protein, conjugate or composition for use according to any one of items 101-103, in the treatment, prognosis or diagnosis of an IL-6 related disorder.

105. IL-6 binding polypeptide, fusion protein, conjugate or composition for use according to any one of items 101-103, in the treatment of an IL-6 related disorder.

106. IL-6 binding polypeptide, fusion protein, conjugate or composition for use according to item 105, wherein said IL-6 related disorder is selected from the group consisting of inflammatory diseases, autoimmune diseases, infectious disease, cancer, diabetes, neurological disease and depression.

107. IL-6 binding polypeptide, fusion protein, conjugate or composition for use according to item 106, wherein said IL-6 related disorder is selected from the group consisting of inflammatory diseases and autoimmune diseases.

108. IL-6 binding polypeptide, fusion protein, conjugate or composition for use according to item 107, wherein said IL-6 related disorder is selected from the group consisting of rheumatoid arthritis (RA), juvenile RA, juvenile idiopathic arthritis or systemic juvenile idiopathic arthritis, vasculitis, psoriatic arthritis, psoriasis, ankylosing spondylitis, chronic inflammatory bowel disease such as Crohn's disease and ulcerative colitis; Grave's disease, Behcet's disease, uveitis, giant cell arteritis, multiple sclerosis (MS), systemic sclerosis, systemic lupus erythematosus (SLE), polymyositis, polymyalgia rheumatic, asthma, chronic obstructive pulmonary disease (COPD), relapsing polychondritis, pancreatitis, peritonitis, nephritis, Kawasaki's disease, Sjögren's syndrome and adult Still's disease.

109. IL-6 binding polypeptide, fusion protein, conjugate or composition for use according to item 106, wherein said IL-6 related disorder is cancer, such as a cancer selected from the group consisting of colitis associated cancer, renal cancer, kidney cancer, prostate cancer, malignant lymphoma, multiple myeloma, Castleman's disease, breast cancer and lung cancer.

110. IL-6 binding polypeptide, fusion protein, conjugate or composition for use according to item 106, wherein said IL-6 related disorder is selected from Alzheimer's disease, HIV, diabetes, sepsis, cachexia, myelodysplastic syndrome (MDS), liver cirrhosis, graft versus host disease, myocardial infarction, endometriosis and osteoporosis.

111. Method of treatment of an IL-6 related disorder, comprising administering to a subject in need thereof an effective amount of an IL-6 binding polypeptide, fusion protein or conjugate according to any one of items 1-93 or a composition according to any one of items 98-99.

112. Method according to item 111, wherein said IL-6 related disorder is selected from the group consisting of inflammatory diseases, autoimmune diseases, infectious disease, cancer, diabetes, neurological disease and depression.

113. Method according to item 112, wherein said IL-6 related disorder is selected from the group consisting of inflammatory diseases and autoimmune diseases.

114. Method according to item 113, wherein said IL-6 related disorder is selected from the group consisting of rheumatoid arthritis (RA), juvenile RA, juvenile idiopathic arthritis or systemic juvenile idiopathic arthritis, vasculitis, psoriatic arthritis, psoriasis, ankylosing spondylitis, chronic inflammatory bowel disease such as Crohn's disease and ulcerative colitis; Grave's disease, Behcet's disease, uveitis, giant cell arteritis, multiple sclerosis (MS), systemic sclerosis, systemic lupus erythematosus (SLE), polymyositis, polymyalgia rheumatic, asthma, chronic obstructive pulmonary disease (COPD), relapsing polychondritis, pancreatitis, peritonitis, nephritis, Kawasaki's disease, Sjögren's syndrome and adult Still's disease.

115. Method according to item 112, wherein said IL-6 related disorder is cancer, such as a cancer selected from the group consisting of selected from the group consisting of colitis associated cancer, renal cancer, kidney cancer, prostate cancer, malignant lymphoma, multiple myeloma, Castleman's disease, breast cancer and lung cancer.

116. Method according to item 112, wherein said IL-6 related disorder is selected from Alzheimer's disease, HIV, diabetes, sepsis, cachexia, myelodysplastic syndrome (MDS), liver cirrhosis, graft versus host disease, myocardial infarction, endometriosis and osteoporosis.

117. Method of detecting IL-6, comprising providing a sample suspected to contain IL-6, contacting said sample with an IL-6 binding polypeptide, fusion protein or conjugate according to any one of items 1-90 or a composition according to any one of items 98-99, and detecting the binding of the IL-6 binding polypeptide, fusion protein, conjugate or composition to indicate the presence of IL-6 in the sample.

118. Method for determining the presence of IL-6 in a subject, the method comprising the steps:
contacting the subject, or a sample isolated from the subject, with an IL-6 binding polypeptide, fusion protein or conjugate according to any one of items 1-93 or a composition according to any one of items 98-99, and
obtaining a value corresponding to the amount of the IL-6 binding polypeptide, fusion protein, conjugate or composition that has bound in said subject or to said sample.

119. Method according to item 118, further comprising a step of comparing said value to a reference.

120. Method according to item 118 or 119, wherein said subject is a mammalian subject, such as a human subject.

121. Method according to any one of items 118-120, wherein the method is performed in vivo.

122. Method according to any one of items 118-120, wherein the method is performed in vitro.

SEQUENCE LISTING (1595 sequences)

SEQ ID NO: 1 - protein, 58 aa, ARTIFICIAL SEQUENCE
  Engineered IL6 binding polypeptide
VDAKYAKEERKAWYEIHLLPNLTVEQMAAFITKLFDDPSQSSELLSEAKKLNDSQAPK

SEQ ID NO: 2 - protein, 58 aa, ARTIFICIAL SEQUENCE
  Engineered IL6 binding polypeptide
VDAKYAKEERDAWWEIHALPNLTVEQMAAFITKLFDDPSQSSELLSEAKKLNDSQAPK

SEQ ID NO: 3 - protein, 58 aa, ARTIFICIAL SEQUENCE
  Engineered IL6 binding polypeptide
VDAKYAKEERHAWYEIHLLPNLTIDQMAAFISKLFDDPSQSSELLSEAKKLNDSQAPK

SEQ ID NO: 4 - protein, 58 aa, ARTIFICIAL SEQUENCE
  Engineered IL6 binding polypeptide
VDAKYAKEERKAWIEIHNLPNLTIDQMAAFITKLFDDPSQSSELLSEAKKLNDSQAPK

SEQ ID NO: 5 - protein, 58 aa, ARTIFICIAL SEQUENCE
  Engineered IL6 binding polypeptide
VDAKYAKEEKQAWREIHLLPNLTIDQMAAFITKLFDDPSQSSELLSEAKKLNDSQAPK

SEQ ID NO: 6 - protein, 58 aa, ARTIFICIAL SEQUENCE
  Engineered IL6 binding polypeptide
VDAKYAKEEKFAWWEIHKLPNLTVDQVAAFITKLFDDPSQSSELLSEAKKLNDSQAPK

SEQ ID NO: 7 - protein, 58 aa, ARTIFICIAL SEQUENCE
  Engineered IL6 binding polypeptide
VDAKYAKEEREAWFEIHTLPNLTVSQMAAFISKLFDDPSQSSELLSEAKKLNDSQAPK

SEQ ID NO: 8 - protein, 58 aa, ARTIFICIAL SEQUENCE
  Engineered IL6 binding polypeptide
VDAKYAKEERHAWFEIHKLPNLTVDQMAAFITKLFDDPSQSSELLSEAKKLNDSQAPK

SEQ ID NO: 9 - protein, 58 aa, ARTIFICIAL SEQUENCE
  Engineered IL6 binding polypeptide
VDAKYAKEEYLAWNEIHKLPNLTVDQMAAFITKLFDDPSQSSELLSEAKKLNDSQAPK

SEQ ID NO: 10 - protein, 58 aa, ARTIFICIAL SEQUENCE
  Engineered IL6 binding polypeptide
VDAKYAKEEAAAWREIHLLPNLTIDQMAAFITKLFDDPSQSSELLSEAKKLNDSQAPK

SEQ ID NO: 11 - protein, 58 aa, ARTIFICIAL SEQUENCE
  Engineered IL6 binding polypeptide
VDAKYAKEEYEAWFEIHALPNLTVEQMAAFITKLFDDPSQSSELLSEAKKLNDSQAPK

SEQ ID NO: 12 - protein, 58 aa, ARTIFICIAL SEQUENCE
  Engineered IL6 binding polypeptide
VDAKYAKEERRAWTEIHSLPNLTIDQMAAFITKLFDDPSQSSELLSEAKKLNDSQAPK

SEQ ID NO: 13 - protein, 58 aa, ARTIFICIAL SEQUENCE
  Engineered IL6 binding polypeptide
VDAKYAKEERNAWYEIHLLPNLTVEQMAAFITKLFDDPSQSSELLSEAKKLNDSQAPK

SEQ ID NO: 14 - protein, 58 aa, ARTIFICIAL SEQUENCE
  Engineered IL6 binding polypeptide
VDAKYAKEERMAWYEIHSLPNLTVDQMAAFITKLFDDPSQSSELLSEAKKLNDSQAPK

SEQ ID NO: 15 - protein, 58 aa, ARTIFICIAL SEQUENCE
  Engineered IL6 binding polypeptide
VDAKYAKEEREAWYEIHVLPNLTVSQIAAFISKLFDDPSQSSELLSEAKKLNDSQAPK

SEQ ID NO: 16 - protein, 58 aa, ARTIFICIAL SEQUENCE
  Engineered IL6 binding polypeptide
VDAKYAKEERTAWFEIHTLPNLTVEQMAAFISKLFDDPSQSSELLSEAKKLNDSQAPK

SEQ ID NO: 17 - protein, 58 aa, ARTIFICIAL SEQUENCE
  Engineered IL6 binding polypeptide
VDAKYAKEEAEAWWEIHLLPNLTVSQMAAFISKLFDDPSQSSELLSEAKKLNDSQAPK

SEQ ID NO: 18 - protein, 58 aa, ARTIFICIAL SEQUENCE
  Engineered IL6 binding polypeptide
VDAKYAKEEREAWYEIHLLPNLTVEQMAAFISKLFDDPSQSSELLSEAKKLNDSQAPK

SEQ ID NO: 19 - protein, 58 aa, ARTIFICIAL SEQUENCE
  Engineered IL6 binding polypeptide
VDAKYAKEERDAWYEIHLLPNLTIDQMAAFISKLFDDPSQSSELLSEAKKLNDSQAPK

SEQ ID NO: 20 - protein, 58 aa, ARTIFICIAL SEQUENCE
  Engineered IL6 binding polypeptide
VDAKYAKEERKAWFEIHALPNLTVDQMAAFISKLFDDPSQSSELLSEAKKLNDSQAPK

SEQ ID NO: 21 - protein, 58 aa, ARTIFICIAL SEQUENCE
  Engineered IL6 binding polypeptide
VDAKYAKEEAKAWFEIHALPNLTVEQMAAFISKLFDDPSQSSELLSEAKKLNDSQAPK

SEQ ID NO: 22 - protein, 58 aa, ARTIFICIAL SEQUENCE
  Engineered IL6 binding polypeptide
VDAKYAKEERTAWYEIHILPNLTVSQMAAFISKLFDDPSQSSELLSEAKKLNDSQAPK

SEQ ID NO: 23 - protein, 58 aa, ARTIFICIAL SEQUENCE
  Engineered IL6 binding polypeptide
VDAKYAKEEQQAWTEIHSLPNLTVDQMAAFISKLFDDPSQSSELLSEAKKLNDSQAPK

SEQ ID NO: 24 - protein, 58 aa, ARTIFICIAL SEQUENCE
  Engineered IL6 binding polypeptide
VDAKYAKEERDAWYEIHLLPNLTVEQIAAFISKLFDDPSQSSELLSEAKKLNDSQAPK

SEQ ID NO: 25 - protein, 58 aa, ARTIFICIAL SEQUENCE
  Engineered IL6 binding polypeptide
VDAKYAKEERVAWYEIHLLPNLTITQMAAFISKLFDDPSQSSELLSEAKKLNDSQAPK

SEQ ID NO: 26 - protein, 58 aa, ARTIFICIAL SEQUENCE
  Engineered IL6 binding polypeptide
VDAKYAKEERQAWYEIHLLPNLTVQQMAAFISKLFDDPSQSSELLSEAKKLNDSQAPK

SEQ ID NO: 27 - protein, 58 aa, ARTIFICIAL SEQUENCE
  Engineered IL6 binding polypeptide
VDAKYAKEEASAWFEIHTLPNLTVQQMAAFISKLFDDPSQSSELLSEAKKLNDSQAPK

SEQ ID NO: 28 - protein, 58 aa, ARTIFICIAL SEQUENCE
  Engineered IL6 binding polypeptide
VDAKYAKEEREAWYEIHVLPNLTVDQMAAFISKLFDDPSQSSELLSEAKKLNDSQAPK

SEQ ID NO: 29 - protein, 58 aa, ARTIFICIAL SEQUENCE
  Engineered IL6 binding polypeptide
VDAKYAKEERKAWYEIHLLPNLTVNQMAAFISKLFDDPSQSSELLSEAKKLNDSQAPK

SEQ ID NO: 30 - protein, 58 aa, ARTIFICIAL SEQUENCE
  Engineered IL6 binding polypeptide
VDAKYAKEERKAWYEIHLLPNLTVDQMAAFISKLFDDPSQSSELLSEAKKLNDSQAPK

SEQ ID NO: 31 - protein, 58 aa, ARTIFICIAL SEQUENCE
  Engineered IL6 binding polypeptide
VDAKYAKEEARAWHEIHILPNLTVSQIAAFISKLFDDPSQSSELLSEAKKLNDSQAPK

SEQ ID NO: 32 - protein, 58 aa, ARTIFICIAL SEQUENCE
  Engineered IL6 binding polypeptide
VDAKYAKEERAAWYEIHLLPNLTVDQMAAFISKLFDDPSQSSELLSEAKKLNDSQAPK

SEQ ID NO: 33 - protein, 58 aa, ARTIFICIAL SEQUENCE
  Engineered IL6 binding polypeptide
VDAKYAKEERQAWYEIHTLPNLTAEQMAAFISKLFDDPSQSSELLSEAKKLNDSQAPK

SEQ ID NO: 34 - protein, 58 aa, ARTIFICIAL SEQUENCE
  Engineered IL6 binding polypeptide
VDAKYAKEERQAWFEIHALPNLTVDQMAAFISKLFDDPSQSSELLSEAKKLNDSQAPK

SEQ ID NO: 35 - protein, 58 aa, ARTIFICIAL SEQUENCE
  Engineered IL6 binding polypeptide
VDAKYAKEEARAWREIHLLPNLTVQQMAAFISKLFDDPSQSSELLSEAKKLNDSQAPK

SEQ ID NO: 36 - protein, 58 aa, ARTIFICIAL SEQUENCE
  Engineered IL6 binding polypeptide
VDAKYAKEEAKAWREIHLLPNLTVTQMAAFISKLFDDPSQSSELLSEAKKLNDSQAPK

SEQ ID NO: 37 - protein, 58 aa, ARTIFICIAL SEQUENCE
  Engineered IL6 binding polypeptide
VDAKYAKEEAEAWREIHLLPNLTVNQMAAFISKLFDDPSQSSELLSEAKKLNDSQAPK

SEQ ID NO: 38 - protein, 58 aa, ARTIFICIAL SEQUENCE
  Engineered IL6 binding polypeptide
VDAKYAKEERDAWYEIHLLPNLTVQQMAAFISKLFDDPSQSSELLSEAKKLNDSQAPK

SEQ ID NO: 39 - protein, 58 aa, ARTIFICIAL SEQUENCE
  Engineered IL6 binding polypeptide
VDAKYAKEEREAWYEIHLLPNLTVRQMAAFISKLFDDPSQSSELLSEAKKLNDSQAPK

SEQ ID NO: 40 - protein, 58 aa, ARTIFICIAL SEQUENCE
  Engineered IL6 binding polypeptide
VDAKYAKEEREAWWEIHKLPNLTVNQMAAFISKLFDDPSQSSELLSEAKKLNDSQAPK

SEQ ID NO: 41 - protein, 58 aa, ARTIFICIAL SEQUENCE
  Engineered IL6 binding polypeptide
VDAKYAKEERRAWYEIHLLPNLTIQQMAAFISKLFDDPSQSSELLSEAKKLNDSQAPK

SEQ ID NO: 42 - protein, 58 aa, ARTIFICIAL SEQUENCE
  Engineered IL6 binding polypeptide
VDAKYAKEEAEAWREIHLLPNLTVHQMAAFISKLFDDPSQSSELLSEAKKLNDSQAPK

SEQ ID NO: 43 - protein, 58 aa, ARTIFICIAL SEQUENCE
  Engineered IL6 binding polypeptide
VDAKYAKEERDAWHEIHLLPNLTVSQMAAFISKLFDDPSQSSELLSEAKKLNDSQAPK

SEQ ID NO: 44 - protein, 58 aa, ARTIFICIAL SEQUENCE
  Engineered IL6 binding polypeptide
VDAKYAKEERRAWYEIHTLPNLTVQQMAAFISKLFDDPSQSSELLSEAKKLNDSQAPK

SEQ ID NO: 45 - protein, 58 aa, ARTIFICIAL SEQUENCE
  Engineered IL6 binding polypeptide
VDAKYAKEERKAWFEIHKLPNLTVEQMAAFISKLFDDPSQSSELLSEAKKLNDSQAPK

SEQ ID NO: 46 - protein, 58 aa, ARTIFICIAL SEQUENCE
  Engineered IL6 binding polypeptide
VDAKYAKEEHHAWTEIHLLPNLTVSQMAAFIQKLFDDPSQSSELLSEAKKLNDSQAPK

SEQ ID NO: 47 - protein, 58 aa, ARTIFICIAL SEQUENCE
  Engineered IL6 binding polypeptide
VDAKYAKEEARAWFEIHALPNLTVQQVAAFISKLFDDPSQSSELLSEAKKLNDSQAPK

SEQ ID NO: 48 - protein, 58 aa, ARTIFICIAL SEQUENCE
  Engineered IL6 binding polypeptide
VDAKYAKEEAKAWREIHILPNLTVQQMAAFISKLFDDPSQSSELLSEAKKLNDSQAPK

SEQ ID NO: 49 - protein, 58 aa, ARTIFICIAL SEQUENCE
  Engineered IL6 binding polypeptide
VDAKYAKEEATAWHEIHTLPNLTVHQMAAFISKLFDDPSQSSELLSEAKKLNDSQAPK

SEQ ID NO: 50 - protein, 58 aa, ARTIFICIAL SEQUENCE
  Engineered IL6 binding polypeptide
VDAKYAKEERSAWYEIHLLPNLTVTQMAAFISKLFDDPSQSSELLSEAKKLNDSQAPK

SEQ ID NO: 51 - protein, 58 aa, ARTIFICIAL SEQUENCE
  Engineered IL6 binding polypeptide
VDAKYAKEERAAWFEIHTLPNLTVQQMAAFISKLFDDPSQSSELLSEAKKLNDSQAPK

SEQ ID NO: 52 - protein, 58 aa, ARTIFICIAL SEQUENCE
  Engineered IL6 binding polypeptide
VDAKYAKEERTAWYEIHLLPNLTVTQMAAFISKLFDDPSQSSELLSEAKKLNDSQAPK

SEQ ID NO: 53 - protein, 58 aa, ARTIFICIAL SEQUENCE
  Engineered IL6 binding polypeptide
VDAKYAKEERKAWFEIHALPNLTVSQMAAFISKLFDDPSQSSELLSEAKKLNDSQAPK

SEQ ID NO: 54 - protein, 58 aa, ARTIFICIAL SEQUENCE
  Engineered IL6 binding polypeptide
VDAKYAKEEHRAWFEIHLLPNLTVEQMAAFISKLFDDPSQSSELLSEAKKLNDSQAPK

SEQ ID NO: 55 - protein, 58 aa, ARTIFICIAL SEQUENCE
  Engineered IL6 binding polypeptide
VDAKYAKEERAAWYEIHILPNLTVQQMAAFIQKLFDDPSQSSELLSEAKKLNDSQAPK

SEQ ID NO: 56 - protein, 58 aa, ARTIFICIAL SEQUENCE
  Engineered IL6 binding polypeptide
VDAKYAKEERQAWYEIHLLPNLTVSQIAAFISKLFDDPSQSSELLSEAKKLNDSQAPK

SEQ ID NO: 57 - protein, 58 aa, ARTIFICIAL SEQUENCE
  Engineered IL6 binding polypeptide
VDAKYAKEEAAAWREIHLLPNLTVQQMAAFISKLFDDPSQSSELLSEAKKLNDSQAPK

SEQ ID NO: 58 - protein, 58 aa, ARTIFICIAL SEQUENCE
  Engineered IL6 binding polypeptide
VDAKYAKEEREAWHEIHILPNLTIHQMAAFISKLFDDPSQSSELLSEAKKLNDSQAPK

SEQ ID NO: 59 - protein, 58 aa, ARTIFICIAL SEQUENCE
  Engineered IL6 binding polypeptide
VDAKYAKEEAQAWLEIHLLPNLTVDQIAAFISKLFDDPSQSSELLSEAKKLNDSQAPK

SEQ ID NO: 60 - protein, 58 aa, ARTIFICIAL SEQUENCE
  Engineered IL6 binding polypeptide
VDAKYAKEERKAWFEIHALPNLTVTQMAAFISKLFDDPSQSSELLSEAKKLNDSQAPK

SEQ ID NO: 61 - protein, 58 aa, ARTIFICIAL SEQUENCE
  Engineered IL6 binding polypeptide
VDAKYAKEERDAWYEIHLLPNLTVEQMAAFISKLFDDPSQSSELLSEAKKLNDSQAPK

SEQ ID NO: 62 - protein, 58 aa, ARTIFICIAL SEQUENCE
  Engineered IL6 binding polypeptide
VDAKYAKEEAAAWYEIHLLPNLTISQIAAFISKLFDDPSQSSELLSEAKKLNDSQAPK

SEQ ID NO: 63 - protein, 58 aa, ARTIFICIAL SEQUENCE
  Engineered IL6 binding polypeptide
VDAKYAKEERVAWYEIHLLPNLTVRQMAAFISKLFDDPSQSSELLSEAKKLNDSQAPK

SEQ ID NO: 64 - protein, 58 aa, ARTIFICIAL SEQUENCE
  Engineered IL6 binding polypeptide
VDAKYAKEEHHAWYEIHILPNLTVSQIAAFISKLFDDPSQSSELLSEAKKLNDSQAPK

SEQ ID NO: 65 - protein, 58 aa, ARTIFICIAL SEQUENCE
  Engineered IL6 binding polypeptide
VDAKYAKEERAAWFEIHALPNLTVEQVAAFIIKLFDDPSQSSELLSEAKKLNDSQAPK

SEQ ID NO: 66 - protein, 58 aa, ARTIFICIAL SEQUENCE
  Engineered IL6 binding polypeptide
VDAKYAKEEQEAWYEIHVLPNLTVTQMAAFISKLFDDPSQSSELLSEAKKLNDSQAPK

SEQ ID NO: 67 - protein, 58 aa, ARTIFICIAL SEQUENCE
  Engineered IL6 binding polypeptide
VDAKYAKEEQQAWTEIHTLPNLTVDQMAAFISKLFDDPSQSSELLSEAKKLNDSQAPK

SEQ ID NO: 68 - protein, 58 aa, ARTIFICIAL SEQUENCE
  Engineered IL6 binding polypeptide
VDAKYAKEERDAWYEIHLLPNLTVTQMAAFISKLFDDPSQSSELLSEAKKLNDSQAPK

SEQ ID NO: 69 - protein, 58 aa, ARTIFICIAL SEQUENCE
  Engineered IL6 binding polypeptide
VDAKYAKEERDAWYEIHLLPNLTISQMAAFISKLFDDPSQSSELLSEAKKLNDSQAPK

SEQ ID NO: 70 - protein, 58 aa, ARTIFICIAL SEQUENCE
  Engineered IL6 binding polypeptide
VDAKYAKEEREAWHEIHILPNLTVEQIAAFISKLFDDPSQSSELLSEAKKLNDSQAPK

SEQ ID NO: 71 - protein, 58 aa, ARTIFICIAL SEQUENCE
  Engineered IL6 binding polypeptide
VDAKYAKEERDAWWEIHALPNLTVDQMAAFISKLFDDPSQSSELLSEAKKLNDSQAPK

SEQ ID NO: 72 - protein, 58 aa, ARTIFICIAL SEQUENCE
  Engineered IL6 binding polypeptide
VDAKYAKEEARAWHEIHVLPNLTVSQMAAFIQKLFDDPSQSSELLSEAKKLNDSQAPK

SEQ ID NO: 73 - protein, 58 aa, ARTIFICIAL SEQUENCE
  Engineered IL6 binding polypeptide
VDAKYAKEEAQAWYEIHTLPNLTVEQMAAFIAKLFDDPSQSSELLSEAKKLNDSQAPK

SEQ ID NO: 74 - protein, 58 aa, ARTIFICIAL SEQUENCE
  Engineered IL6 binding polypeptide
VDAKYAKEERSAWWEIHTLPNLTVTQMAAFISKLFDDPSQSSELLSEAKKLNDSQAPK

SEQ ID NO: 75 - protein, 58 aa, ARTIFICIAL SEQUENCE
  Engineered IL6 binding polypeptide
VDAKYAKEEADAWWEIHALPNLTIDQMAAFISKLFDDPSQSSELLSEAKKLNDSQAPK

SEQ ID NO: 76 - protein, 58 aa, ARTIFICIAL SEQUENCE
  Engineered IL6 binding polypeptide
VDAKYAKEEAEAWYEIHLLPNLTVDQMAAFIIKLFDDPSQSSELLSEAKKLNDSQAPK

SEQ ID NO: 77 - protein, 58 aa, ARTIFICIAL SEQUENCE
  Engineered IL6 binding polypeptide
VDAKYAKEERAAWYEIHSLPNLTVDQMAAFISKLFDDPSQSSELLSEAKKLNDSQAPK

SEQ ID NO: 78 - protein, 58 aa, ARTIFICIAL SEQUENCE
  Engineered IL6 binding polypeptide
VDAKYAKEEQQAWLEIHLLPNLTIEQMAAFISKLFDDPSQSSELLSEAKKLNDSQAPK

SEQ ID NO: 79 - protein, 58 aa, ARTIFICIAL SEQUENCE
  Engineered IL6 binding polypeptide
VDAKYAKEERDAWYEIHLLPNLTVHQIAAFISKLFDDPSQSSELLSEAKKLNDSQAPK

SEQ ID NO: 80 - protein, 58 aa, ARTIFICIAL SEQUENCE
  Engineered IL6 binding polypeptide
VDAKYAKEERDAWYEIHTLPNLTVEQMAAFIWKLFDDPSQSSELLSEAKKLNDSQAPK

SEQ ID NO: 81 - protein, 58 aa, ARTIFICIAL SEQUENCE
  Engineered IL6 binding polypeptide
VDAKYAKEEQHAWLEIHKLPNLTVEQIAAFISKLFDDPSQSSELLSEAKKLNDSQAPK

SEQ ID NO: 82 - protein, 58 aa, ARTIFICIAL SEQUENCE
  Engineered IL6 binding polypeptide
VDAKYAKEEAAAWFEIHTLPNLTVDQMAAFISKLFDDPSQSSELLSEAKKLNDSQAPK

SEQ ID NO: 83 - protein, 58 aa, ARTIFICIAL SEQUENCE
  Engineered IL6 binding polypeptide
VDAKYAKEERDAWFEIHTLPNLTVTQMAAFIIKLFDDPSQSSELLSEAKKLNDSQAPK

SEQ ID NO: 84 - protein, 58 aa, ARTIFICIAL SEQUENCE
  Engineered IL6 binding polypeptide
VDAKYAKEERHAWHEIHILPNLTANQIAAFISKLFDDPSQSSELLSEAKKLNDSQAPK

SEQ ID NO: 85 - protein, 58 aa, ARTIFICIAL SEQUENCE
  Engineered IL6 binding polypeptide
VDAKYAKEEREAWFEIHLLPNLTISQMAAFISKLFDDPSQSSELLSEAKKLNDSQAPK

SEQ ID NO: 86 - protein, 58 aa, ARTIFICIAL SEQUENCE
  Engineered IL6 binding polypeptide
VDAKYAKEEAEAWWEIHLLPNLTVQQIAAFISKLFDDPSQSSELLSEAKKLNDSQAPK

SEQ ID NO: 87 - protein, 58 aa, ARTIFICIAL SEQUENCE
  Engineered IL6 binding polypeptide
VDAKYAKEEAHAWYEIHILPNLTVSQMAAFISKLFDDPSQSSELLSEAKKLNDSQAPK

SEQ ID NO: 88 - protein, 58 aa, ARTIFICIAL SEQUENCE
  Engineered IL6 binding polypeptide
VDAKYAKEERDAWYEIHLLPNLTIDQIAAFISKLFDDPSQSSELLSEAKKLNDSQAPK

SEQ ID NO: 89 - protein, 58 aa, ARTIFICIAL SEQUENCE
  Engineered IL6 binding polypeptide
VDAKYAKEEQRAWREIHLLPNLTIEQMSAFISKLFDDPSQSSELLSEAKKLNDSQAPK

SEQ ID NO: 90 - protein, 58 aa, ARTIFICIAL SEQUENCE
  Engineered IL6 binding polypeptide
VDAKYAKEEYDAWMEIHLLPNLTVDQMAAFITKLFDDPSQSSELLSEAKKLNDSQAPK

SEQ ID NO: 91 - protein, 58 aa, ARTIFICIAL SEQUENCE
  Engineered IL6 binding polypeptide
VDAKYAKEEKHAWREIHLLPNLTVEQMAAFITKLFDDPSQSSELLSEAKKLNDSQAPK

SEQ ID NO: 92 - protein, 58 aa, ARTIFICIAL SEQUENCE
  Engineered IL6 binding polypeptide
VDAKYAKEEKKAWTEIHLLPNLTIEQMAAFITKLFDDPSQSSELLSEAKKLNDSQAPK

SEQ ID NO: 93 - protein, 58 aa, ARTIFICIAL SEQUENCE
  Engineered IL6 binding polypeptide
VDAKYAKEERFAWTEIHLLPNLTVDQMAAFITKLFDDPSQSSELLSEAKKLNDSQAPK

SEQ ID NO: 94 - protein, 58 aa, ARTIFICIAL SEQUENCE
  Engineered IL6 binding polypeptide
VDAKYAKEERHAWTEIHLLPNLTIDQMAAFITKLFDDPSQSSELLSEAKKLNDSQAPK

SEQ ID NO: 95 - protein, 58 aa, ARTIFICIAL SEQUENCE
  Engineered IL6 binding polypeptide
VDAKYAKEERAAWFEIHALPNLTVEQVAAFITKLFDDPSQSSELLSEAKKLNDSQAPK

SEQ ID NO: 96 - protein, 58 aa, ARTIFICIAL SEQUENCE
  Engineered IL6 binding polypeptide
VDAKYAKEEKQAWYEIHNLPNLTVDQMAAFISKLFDDPSQSSELLSEAKKLNDSQAPK

SEQ ID NO: 97 - protein, 58 aa, ARTIFICIAL SEQUENCE
  Engineered IL6 binding polypeptide
VDAKYAKEEAQAWWEIHALPNLTVDQVAAFITKLFDDPSQSSELLSEAKKLNDSQAPK

SEQ ID NO: 98 - protein, 58 aa, ARTIFICIAL SEQUENCE
  Engineered IL6 binding polypeptide
VDAKYAKEEYEAWYEIHILPNLTVDQIAAFITKLFDDPSQSSELLSEAKKLNDSQAPK

SEQ ID NO: 99 - protein, 58 aa, ARTIFICIAL SEQUENCE
  Engineered IL6 binding polypeptide
VDAKYAKEEYEAWHEIHILPNLTVDQMAAFITKLFDDPSQSSELLSEAKKLNDSQAPK

SEQ ID NO: 100 - protein, 58 aa, ARTIFICIAL SEQUENCE
  Engineered IL6 binding polypeptide
VDAKYAKEERMAWMEIHLLPNLTVEQMAAFISKLFDDPSQSSELLSEAKKLNDSQAPK

SEQ ID NO: 101 - protein, 58 aa, ARTIFICIAL SEQUENCE
  Engineered IL6 binding polypeptide
VDAKYAKEEYDAWVEIHALPNLTVEQVAAFITKLFDDPSQSSELLSEAKKLNDSQAPK

SEQ ID NO: 102 - protein, 58 aa, ARTIFICIAL SEQUENCE
  Engineered IL6 binding polypeptide
VDAKYAKEEYEAWVEIHKLPNLTIDQMAAFITKLFDDPSQSSELLSEAKKLNDSQAPK

SEQ ID NO: 103 - protein, 58 aa, ARTIFICIAL SEQUENCE
  Engineered IL6 binding polypeptide
VDAKYAKEEYHAWYEIHLLPNLTIDQMAAFITKLFDDPSQSSELLSEAKKLNDSQAPK

SEQ ID NO: 104 - protein, 58 aa, ARTIFICIAL SEQUENCE
  Engineered IL6 binding polypeptide
VDAKYAKEEKDAWYEIHLLPNLTVEQIAAFITKLFDDPSQSSELLSEAKKLNDSQAPK

SEQ ID NO: 105 - protein, 58 aa, ARTIFICIAL SEQUENCE
  Engineered IL6 binding polypeptide
VDAKYAKEEKHAWHEIHILPNLTVEQMAAFITKLFDDPSQSSELLSEAKKLNDSQAPK

SEQ ID NO: 106 - protein, 58 aa, ARTIFICIAL SEQUENCE
  Engineered IL6 binding polypeptide
VDAKYAKEEKAAWFEIHALPNLTVEQVAAFITKLFDDPSQSSELLSEAKKLNDSQAPK

SEQ ID NO: 107 - protein, 58 aa, ARTIFICIAL SEQUENCE
  Engineered IL6 binding polypeptide
VDAKYAKEEYHAWMEIHLLPNLTVSQMAAFITKLFDDPSQSSELLSEAKKLNDSQAPK

SEQ ID NO: 108 - protein, 58 aa, ARTIFICIAL SEQUENCE
  Engineered IL6 binding polypeptide
VDAKYAKEEAFAWKEIHLLPNLTIDQMAAFITKLFDDPSQSSELLSEAKKLNDSQAPK

SEQ ID NO: 109 - protein, 58 aa, ARTIFICIAL SEQUENCE
  Engineered IL6 binding polypeptide
VDAKYAKEEYEAWYEIHLLPNLTVSQIAAFITKLFDDPSQSSELLSEAKKLNDSQAPK

SEQ ID NO: 110 - protein, 58 aa, ARTIFICIAL SEQUENCE
  Engineered IL6 binding polypeptide
VDAKYAKEEYYAWWEIHKLPNLTVDQMAAFITKLFDDPSQSSELLSEAKKLNDSQAPK

SEQ ID NO: 111 - protein, 58 aa, ARTIFICIAL SEQUENCE
  Engineered IL6 binding polypeptide
VDAKYAKEEAVAWKEIHILPNLTVSQMAAFITKLFDDPSQSSELLSEAKKLNDSQAPK

SEQ ID NO: 112 - protein, 58 aa, ARTIFICIAL SEQUENCE
  Engineered IL6 binding polypeptide
VDAKYAKEEKAAWYEIHLLPNLTIEQMAAFISKLFDDPSQSSELLSEAKKLNDSQAPK

SEQ ID NO: 113 - protein, 58 aa, ARTIFICIAL SEQUENCE
  Engineered IL6 binding polypeptide
VDAKYAKEERAAWTEIHLLPNLTVEQMAAFITKLFDDPSQSSELLSEAKKLNDSQAPK

SEQ ID NO: 114 - protein, 58 aa, ARTIFICIAL SEQUENCE
  Engineered IL6 binding polypeptide
VDAKYAKEERMAWYEIHTLPNLTVEQMAAFITKLFDDPSQSSELLSEAKKLNDSQAPK

SEQ ID NO: 115 - protein, 58 aa, ARTIFICIAL SEQUENCE
  Engineered IL6 binding polypeptide
VDAKYAKEEHHAWREIHLLPNLTVDQMAAFITKLFDDPSQSSELLSEAKKLNDSQAPK

SEQ ID NO: 116 - protein, 58 aa, ARTIFICIAL SEQUENCE
  Engineered IL6 binding polypeptide
VDAKYAKEEAKAWMEIHLLPNLTIDQMAAFITKLFDDPSQSSELLSEAKKLNDSQAPK

SEQ ID NO: 117 - protein, 58 aa, ARTIFICIAL SEQUENCE
  Engineered IL6 binding polypeptide
VDAKYAKEEKAAWYEIHLLPNLTVDQIAAFITKLFDDPSQSSELLSEAKKLNDSQAPK

SEQ ID NO: 118 - protein, 58 aa, ARTIFICIAL SEQUENCE
  Engineered IL6 binding polypeptide
VDAKYAKEEKHAWMEIHKLPNLTVDQMAAFITKLFDDPSQSSELLSEAKKLNDSQAPK

SEQ ID NO: 119 - protein, 58 aa, ARTIFICIAL SEQUENCE
  Engineered IL6 binding polypeptide
VDAKYAKEEKAAWNEIHKLPNLTVDQMAAFITKLFDDPSQSSELLSEAKKLNDSQAPK

SEQ ID NO: 120 - protein, 58 aa, ARTIFICIAL SEQUENCE
  Engineered IL6 binding polypeptide
VDAKYAKEERKAWVEIHNLPNLTVDQMAAFITKLFDDPSQSSELLSEAKKLNDSQAPK

SEQ ID NO: 121 - protein, 58 aa, ARTIFICIAL SEQUENCE
  Engineered IL6 binding polypeptide
VDAKYAKEEAIAWHEIHVLPNLTVDQIAAFITKLFDDPSQSSELLSEAKKLNDSQAPK

SEQ ID NO: 122 - protein, 58 aa, ARTIFICIAL SEQUENCE
  Engineered IL6 binding polypeptide
VDAKYAKEEYEAWYEIHLLPNLTIQQMAAFISKLFDDPSQSSELLSEAKKLNDSQAPK

SEQ ID NO: 123 - protein, 58 aa, ARTIFICIAL SEQUENCE
  Engineered IL6 binding polypeptide
VDAKYAKEEYHAWVEIHNLPNLTIDQMAAFITKLFDDPSQSSELLSEAKKLNDSQAPK

SEQ ID NO: 124 - protein, 58 aa, ARTIFICIAL SEQUENCE
  Engineered IL6 binding polypeptide
VDAKYAKEEAFAWREIHLLPNLTIDQMAAFITKLFDDPSQSSELLSEAKKLNDSQAPK

SEQ ID NO: 125 - protein, 58 aa, ARTIFICIAL SEQUENCE
  Engineered IL6 binding polypeptide
VDAKYAKEEKEAWYEIHLLPNLTVSQMAAFITKLFDDPSQSSELLSEAKKLNDSQAPK

SEQ ID NO: 126 - protein, 58 aa, ARTIFICIAL SEQUENCE
  Engineered IL6 binding polypeptide
VDAKYAKEERKAWYEIHLLPNLTIDQMAAFITKLFDDPSQSSELLSEAKKLNDSQAPK

SEQ ID NO: 127 - protein, 58 aa, ARTIFICIAL SEQUENCE
  Engineered IL6 binding polypeptide
VDAKYAKEEYDAWYEIHTLPNLTVDQMAAFISKLFDDPSQSSELLSEAKKLNDSQAPK

SEQ ID NO: 128 - protein, 58 aa, ARTIFICIAL SEQUENCE
  Engineered IL6 binding polypeptide
VDAKYAKEERNAWTEIHLLPNLTIEQMAAFITKLFDDPSQSSELLSEAKKLNDSQAPK

SEQ ID NO: 129 - protein, 58 aa, ARTIFICIAL SEQUENCE
  Engineered IL6 binding polypeptide
VDAKYAKEEYKAWLEIHNLPNLTVDQMAAFITKLFDDPSQSSELLSEAKKLNDSQAPK

SEQ ID NO: 130 - protein, 58 aa, ARTIFICIAL SEQUENCE
  Engineered IL6 binding polypeptide
VDAKYAKEEYEAWMEIHLLPNLTVEQIAAFITKLFDDPSQSSELLSEAKKLNDSQAPK

SEQ ID NO: 131 - protein, 58 aa, ARTIFICIAL SEQUENCE
  Engineered IL6 binding polypeptide
VDAKYAKEERDAWFEIHKLPNLTVDQMAAFITKLFDDPSQSSELLSEAKKLNDSQAPK

SEQ ID NO: 132 - protein, 58 aa, ARTIFICIAL SEQUENCE
  Engineered IL6 binding polypeptide
VDAKYAKEEAYAWKEIHLLPNLTVDQMAAFITKLFDDPSQSSELLSEAKKLNDSQAPK

SEQ ID NO: 133 - protein, 58 aa, ARTIFICIAL SEQUENCE
  Engineered IL6 binding polypeptide
VDAKYAKEEYFAWWEIHKLPNLTVNQMAAFITKLFDDPSQSSELLSEAKKLNDSQAPK

SEQ ID NO: 134 - protein, 58 aa, ARTIFICIAL SEQUENCE
  Engineered IL6 binding polypeptide
VDAKYAKEEKQAWVEIHNLPNLTITQMAAFITKLFDDPSQSSELLSEAKKLNDSQAPK

SEQ ID NO: 135 - protein, 58 aa, ARTIFICIAL SEQUENCE
  Engineered IL6 binding polypeptide
VDAKYAKEEQRAWYEIHILPNLTIDQMAAFITKLFDDPSQSSELLSEAKKLNDSQAPK

SEQ ID NO: 136 - protein, 58 aa, ARTIFICIAL SEQUENCE
  Engineered IL6 binding polypeptide
VDAKYAKEEARAWREIHALPNLTIDQMAAFITKLFDDPSQSSELLSEAKKLNDSQAPK

SEQ ID NO: 137 - protein, 58 aa, ARTIFICIAL SEQUENCE
  Engineered IL6 binding polypeptide
VDAKYAKEERYAWNEIHKLPNLTVDQMAAFITKLFDDPSQSSELLSEAKKLNDSQAPK

SEQ ID NO: 138 - protein, 58 aa, ARTIFICIAL SEQUENCE
  Engineered IL6 binding polypeptide
VDAKYAKEEAKAWYEIHILPNLTVDQIAAFITKLFDDPSQSSELLSEAKKLNDSQAPK

SEQ ID NO: 139 - protein, 58 aa, ARTIFICIAL SEQUENCE
  Engineered IL6 binding polypeptide
VDAKYAKEEARAWHEIHILPNLTIDQMAAFITKLFDDPSQSSELLSEAKKLNDSQAPK

SEQ ID NO: 140 - protein, 58 aa, ARTIFICIAL SEQUENCE
  Engineered IL6 binding polypeptide
VDAKYAKEEKKAWYEIHLLPNLTIEQMAAFITKLFDDPSQSSELLSEAKKLNDSQAPK

SEQ ID NO: 141 - protein, 58 aa, ARTIFICIAL SEQUENCE
  Engineered IL6 binding polypeptide
VDAKYAKEEARAWTEIHLLPNLTVDQMAAFITKLFDDPSQSSELLSEAKKLNDSQAPK

SEQ ID NO: 142 - protein, 58 aa, ARTIFICIAL SEQUENCE
  Engineered IL6 binding polypeptide
VDAKYAKEERSAWMEIHLLPNLTVDQMAAFITKLFDDPSQSSELLSEAKKLNDSQAPK

SEQ ID NO: 143 - protein, 58 aa, ARTIFICIAL SEQUENCE
  Engineered IL6 binding polypeptide
VDAKYAKEEREAWFEIHILPNLTIDQMAAFITKLFDDPSQSSELLSEAKKLNDSQAPK

SEQ ID NO: 144 - protein, 58 aa, ARTIFICIAL SEQUENCE
  Engineered IL6 binding polypeptide
VDAKYAKEEYEAWTEIHLLPNLTIEQMAAFITKLFDDPSQSSELLSEAKKLNDSQAPK

SEQ ID NO: 145 - protein, 58 aa, ARTIFICIAL SEQUENCE
  Engineered IL6 binding polypeptide
VDAKYAKEEYEAWVEIHNLPNLTITQMAAFITKLFDDPSQSSELLSEAKKLNDSQAPK

SEQ ID NO: 146 - protein, 58 aa, ARTIFICIAL SEQUENCE
  Engineered IL6 binding polypeptide
VDAKYAKEEYKAWHEIHILPNLTVDQMAAFITKLFDDPSQSSELLSEAKKLNDSQAPK

SEQ ID NO: 147 - protein, 58 aa, ARTIFICIAL SEQUENCE
  Engineered IL6 binding polypeptide
VDAKYAKEEREAWMEIHLLPNLTIDQMAAFITKLFDDPSQSSELLSEAKKLNDSQAPK

SEQ ID NO: 148 - protein, 58 aa, ARTIFICIAL SEQUENCE
  Engineered IL6 binding polypeptide
VDAKYAKEEYKAWVEIHLLPNLTVDQIAAFITKLFDDPSQSSELLSEAKKLNDSQAPK

SEQ ID NO: 149 - protein, 58 aa, ARTIFICIAL SEQUENCE
  Engineered IL6 binding polypeptide
VDAKYAKEEKIAWYEIHLLPNLTVNQIAAFITKLFDDPSQSSELLSEAKKLNDSQAPK

SEQ ID NO: 150 - protein, 58 aa, ARTIFICIAL SEQUENCE
  Engineered IL6 binding polypeptide
VDAKYAKEEAYAWKEIHLLPNLTIEQMAAFISKLFDDPSQSSELLSEAKKLNDSQAPK

SEQ ID NO: 151 - protein, 58 aa, ARTIFICIAL SEQUENCE
  Engineered IL6 binding polypeptide
VDAKYAKEEQVAWWEISHLPNLTITQVVAFIQKLFDDPSQSSELLSEAKKLNDSQAPK

SEQ ID NO: 152 - protein, 58 aa, ARTIFICIAL SEQUENCE
  Engineered IL6 binding polypeptide
VDAKYAKEEQVAWWEISHLPNLTIEQVVAFIQKLFDDPSQSSELLSEAKKLNDSQAPK

SEQ ID NO: 153 - protein, 58 aa, ARTIFICIAL SEQUENCE
  Engineered IL6 binding polypeptide
VDAKYAKEEREAWYEIHTLPNLTAQQMAAFIVKLYDDPSQSSELLSEAKKLNDSQAPK

SEQ ID NO: 154 - protein, 58 aa, ARTIFICIAL SEQUENCE
  Engineered IL6 binding polypeptide
VDAKYAKEEAQAWLEIHLLPNLTVDQMAAFISKLFDDPSQSSELLSEAKKLNDSQAPK

SEQ ID NO: 155 - protein, 58 aa, ARTIFICIAL SEQUENCE
  Engineered IL6 binding polypeptide
VDAKYAKEERHAWFEIHSLPNLTVNQMSAFISKLFDDPSQSSELLSEAKKLNDSQAPK

SEQ ID NO: 156 - protein, 58 aa, ARTIFICIAL SEQUENCE
  Engineered IL6 binding polypeptide
VDAKYAKEEADAWWEIHALPNLTVDQMAAFISKLFDDPSQSSELLSEAKKLNDSQAPK

SEQ ID NO: 157 - protein, 58 aa, ARTIFICIAL SEQUENCE
  Engineered IL6 binding polypeptide
VDAKYAKEEARAWLEIHALPNLTVTQMAAFIIKLYDDPSQSSELLSEAKKLNDSQAPK

SEQ ID NO: 158 - protein, 58 aa, ARTIFICIAL SEQUENCE
  Engineered IL6 binding polypeptide
VDAKYAKEERRAWTEIHLLPNLTVDQMAAFISKLFDDPSQSSELLSEAKKLNDSQAPK

SEQ ID NO: 159 - protein, 58 aa, ARTIFICIAL SEQUENCE
  Engineered IL6 binding polypeptide
VDAKYAKEERHAWYEIHTLPNLTVTQMSAFIQKLFDDPSQSSELLSEAKKLNDSQAPK

SEQ ID NO: 160 - protein, 58 aa, ARTIFICIAL SEQUENCE
  Engineered IL6 binding polypeptide
VDAKYAKEEAQAWFEIHLLPNLTIDQMAAFISKLFDDPSQSSELLSEAKKLNDSQAPK

SEQ ID NO: 161 - protein, 58 aa, ARTIFICIAL SEQUENCE
  Engineered IL6 binding polypeptide
VDAKYAKEERAAWHEIHVLPNLTVSQMAAFIIKLFDDPSQSSELLSEAKKLNDSQAPK

SEQ ID NO: 162 - protein, 58 aa, ARTIFICIAL SEQUENCE
  Engineered IL6 binding polypeptide
VDAKYAKEEREAWYEIHVLPNLTVHQRAAFISKLFDDPSQSSELLSEAKKLNDSQAPK

SEQ ID NO: 163 - protein, 58 aa, ARTIFICIAL SEQUENCE
  Engineered IL6 binding polypeptide
VDAKYAKEERHAWYEIHLLPNLTVHQIAAFISKLFDDPSQSSELLSEAKKLNDSQAPK

SEQ ID NO: 164 - protein, 58 aa, ARTIFICIAL SEQUENCE
  Engineered IL6 binding polypeptide
VDAKYAKEERHAWFEIHTLPNLTINQRTAFIQKLFDDPSQSSELLSEAKKLNDSQAPK

SEQ ID NO: 165 - protein, 58 aa, ARTIFICIAL SEQUENCE
  Engineered IL6 binding polypeptide
VDAKYAKEERHAWYEIHVLPNLTVSQMAAFIMKLFDDPSQSSELLSEAKKLNDSQAPK

SEQ ID NO: 166 - protein, 58 aa, ARTIFICIAL SEQUENCE
  Engineered IL6 binding polypeptide
VDAKYAKEERDAWLEIHMLPNLTITQVAAFISKLFDDPSQSSELLSEAKKLNDSQAPK

SEQ ID NO: 167 - protein, 58 aa, ARTIFICIAL SEQUENCE
  Engineered IL6 binding polypeptide
VDAKYAKEEARAWHEIHVLPNLTAEQMAAFISKLFDDPSQSSELLSEAKKLNDSQAPK

SEQ ID NO: 168 - protein, 58 aa, ARTIFICIAL SEQUENCE
  Engineered IL6 binding polypeptide
VDAKYAKEEAEAWLEIHLLPNLTVEQITAFISKLFDDPSQSSELLSEAKKLNDSQAPK

SEQ ID NO: 169 - protein, 58 aa, ARTIFICIAL SEQUENCE
  Engineered IL6 binding polypeptide
VDAKYAKEERDAWHEIHLLPNLTVEQRAAFISKLFDDPSQSSELLSEAKKLNDSQAPK

SEQ ID NO: 170 - protein, 58 aa, ARTIFICIAL SEQUENCE
  Engineered IL6 binding polypeptide
VDAKYAKEERKAWTEIHSLPNLTVTQMAAFISKLFDDPSQSSELLSEAKKLNDSQAPK

SEQ ID NO: 171 - protein, 58 aa, ARTIFICIAL SEQUENCE
  Engineered IL6 binding polypeptide
VDAKYAKEERDAWHEIHILPNLTVEQMSAFISKLFDDPSQSSELLSEAKKLNDSQAPK

SEQ ID NO: 172 - protein, 58 aa, ARTIFICIAL SEQUENCE
  Engineered IL6 binding polypeptide
VDAKYAKEEAEAWFEIHALPNLTAEQMAAFISKLFDDPSQSSELLSEAKKLNDSQAPK

SEQ ID NO: 173 - protein, 58 aa, ARTIFICIAL SEQUENCE
  Engineered IL6 binding polypeptide
VDAKYAKEEHQAWWEIHLLPNLTVDQMSAFISKLFDDPSQSSELLSEAKKLNDSQAPK

SEQ ID NO: 174 - protein, 58 aa, ARTIFICIAL SEQUENCE
  Engineered IL6 binding polypeptide
VDAKYAKEERDAWHEIHKLPNLTVNQVAAFISKLFDDPSQSSELLSEAKKLNDSQAPK

SEQ ID NO: 175 - protein, 58 aa, ARTIFICIAL SEQUENCE
  Engineered IL6 binding polypeptide
VDAKYAKEEADAWFEIHLLPNLTVDQIAAFIQKLFDDPSQSSELLSEAKKLNDSQAPK

SEQ ID NO: 176 - protein, 58 aa, ARTIFICIAL SEQUENCE
  Engineered IL6 binding polypeptide
VDAKYAKEERAAWYEIHVLPNLTVEQMAAFIQKLFDDPSQSSELLSEAKKLNDSQAPK

SEQ ID NO: 177 - protein, 58 aa, ARTIFICIAL SEQUENCE
  Engineered IL6 binding polypeptide
VDAKYAKEEHRAWHEIHLLPNLTVNQIAAFISKLFDDPSQSSELLSEAKKLNDSQAPK

SEQ ID NO: 178 - protein, 58 aa, ARTIFICIAL SEQUENCE
  Engineered IL6 binding polypeptide
VDAKYAKEEAVAWHEIHMLPNLTVEQMAAFISKLFDDPSQSSELLSEAKKLNDSQAPK

SEQ ID NO: 179 - protein, 58 aa, ARTIFICIAL SEQUENCE
  Engineered IL6 binding polypeptide
VDAKYAKEEREAWWEIHALPNLTVSQMAAFISKLFDDPSQSSELLSEAKKLNDSQAPK

SEQ ID NO: 180 - protein, 58 aa, ARTIFICIAL SEQUENCE
  Engineered IL6 binding polypeptide
VDAKYAKEERKAWFEIHSLPNLTVDQMSAFISKLFDDPSQSSELLSEAKKLNDSQAPK

SEQ ID NO: 181 - protein, 58 aa, ARTIFICIAL SEQUENCE
  Engineered IL6 binding polypeptide
VDAKYAKEEQRAWWEIHTLPNLTTDQMAAFISKLFDDPSQSSELLSEAKKLNDSQAPK

SEQ ID NO: 182 - protein, 58 aa, ARTIFICIAL SEQUENCE
  Engineered IL6 binding polypeptide
VDAKYAKEERQAWFEIHALPNLTVDQAAAFIIKLYDDPSQSSELLSEAKKLNDSQAPK

SEQ ID NO: 183 - protein, 58 aa, ARTIFICIAL SEQUENCE
  Engineered IL6 binding polypeptide
VDAKYAKEEARAWTEIHALPNLTVDQMAAFIIKLYDDPSQSSELLSEAKKLNDSQAPK

SEQ ID NO: 184 - protein, 58 aa, ARTIFICIAL SEQUENCE
  Engineered IL6 binding polypeptide
VDAKYAKEERRAWHEIHMLPNLTVTQMSAFISKLFDDPSQSSELLSEAKKLNDSQAPK

SEQ ID NO: 185 - protein, 58 aa, ARTIFICIAL SEQUENCE
  Engineered IL6 binding polypeptide
VDAKYAKEEAKAWLEIHKLPNLTVNQMAAFISKLFDDPSQSSELLSEAKKLNDSQAPK

SEQ ID NO: 186 - protein, 58 aa, ARTIFICIAL SEQUENCE
  Engineered IL6 binding polypeptide
VDAKYAKEEREAWHEIHLLPNLTISQIAAFISKLFDDPSQSSELLSEAKKLNDSQAPK

SEQ ID NO: 187 - protein, 58 aa, ARTIFICIAL SEQUENCE
  Engineered IL6 binding polypeptide
VDAKYAKEEQHAWYEIHLLPNLTVTQMAAFISKLFDDPSQSSELLSEAKKLNDSQAPK

SEQ ID NO: 188 - protein, 58 aa, ARTIFICIAL SEQUENCE
  Engineered IL6 binding polypeptide
VDAKYAKEEHKAWFEIHLLPNLTISQMAAFISKLFDDPSQSSELLSEAKKLNDSQAPK

SEQ ID NO: 189 - protein, 58 aa, ARTIFICIAL SEQUENCE
  Engineered IL6 binding polypeptide
VDAKYAKEERRAWYEIHLLPNLTVTQMTAFISKLFDDPSQSSELLSEAKKLNDSQAPK

SEQ ID NO: 190 - protein, 58 aa, ARTIFICIAL SEQUENCE
  Engineered IL6 binding polypeptide
VDAKYAKEERHAWTEIHILPNLTVRQMAAFISKLFDDPSQSSELLSEAKKLNDSQAPK

SEQ ID NO: 191 - protein, 58 aa, ARTIFICIAL SEQUENCE
  Engineered IL6 binding polypeptide
VDAKYAKEERHAWHEIHLLPNLTIQQMAAFISKLFDDPSQSSELLSEAKKLNDSQAPK

SEQ ID NO: 192 - protein, 58 aa, ARTIFICIAL SEQUENCE
  Engineered IL6 binding polypeptide
VDAKYAKEEQHAWTEIHKLPNLTIQQMAAFIQKLFDDPSQSSELLSEAKKLNDSQAPK

SEQ ID NO: 193 - protein, 58 aa, ARTIFICIAL SEQUENCE
  Engineered IL6 binding polypeptide
VDAKYAKEEHRAWTEIHLLPNLTVSQMVAFISKLFDDPSQSSELLSEAKKLNDSQAPK

SEQ ID NO: 194 - protein, 58 aa, ARTIFICIAL SEQUENCE
  Engineered IL6 binding polypeptide
VDAKYAKEEQDAWYEIHVLPNLTVEQLVAFISKLFDDPSQSSELLSEAKKLNDSQAPK

SEQ ID NO: 195 - protein, 58 aa, ARTIFICIAL SEQUENCE
  Engineered IL6 binding polypeptide
VDAKYAKEEREAWHEIHSLPNLTVDQMTAFIIKLMDDPSQSSELLSEAKKLNDSQAPK

SEQ ID NO: 196 - protein, 58 aa, ARTIFICIAL SEQUENCE
  Engineered IL6 binding polypeptide
VDAKYAKEEAAAWFEIHLLPNLTTEQMAAFIMKLFDDPSQSSELLSEAKKLNDSQAPK

SEQ ID NO: 197 - protein, 58 aa, ARTIFICIAL SEQUENCE
  Engineered IL6 binding polypeptide
VDAKYAKEERAAWYEIHILPNLTVRQMAAFISKLFDDPSQSSELLSEAKKLNDSQAPK

SEQ ID NO: 198 - protein, 58 aa, ARTIFICIAL SEQUENCE
  Engineered IL6 binding polypeptide
VDAKYAKEEARAWTEIHALPNLTVDQVTAFIIKLYDDPSQSSELLSEAKKLNDSQAPK

SEQ ID NO: 199 - protein, 58 aa, ARTIFICIAL SEQUENCE
  Engineered IL6 binding polypeptide
VDAKYAKEEQRAWFEIHTLPNLTVDQIEAFISKLFDDPSQSSELLSEAKKLNDSQAPK

SEQ ID NO: 200 - protein, 58 aa, ARTIFICIAL SEQUENCE
  Engineered IL6 binding polypeptide
VDAKYAKEEAAAWHEIHILPNLTVSQMAAFISKLFDDPSQSSELLSEAKKLNDSQAPK

SEQ ID NO: 201 - protein, 58 aa, ARTIFICIAL SEQUENCE
  Engineered IL6 binding polypeptide
VDAKYAKEEAQAWWEIHSLPNLTVEQTSAFIQKLFDDPSQSSELLSEAKKLNDSQAPK

SEQ ID NO: 202 - protein, 58 aa, ARTIFICIAL SEQUENCE
  Engineered IL6 binding polypeptide
VDAKYAKEEREAWHEIHALPNLTIDQRVAFISKLFDDPSQSSELLSEAKKLNDSQAPK

SEQ ID NO: 203 - protein, 58 aa, ARTIFICIAL SEQUENCE
  Engineered IL6 binding polypeptide
VDAKYAKEEREAWYEIHLLPNLTINQMAAFISKLFDDPSQSSELLSEAKKLNDSQAPK

SEQ ID NO: 204 - protein, 58 aa, ARTIFICIAL SEQUENCE
  Engineered IL6 binding polypeptide
VDAKYAKEERDAWYEIHLLPNLTIRQMAAFISKLFDDPSQSSELLSEAKKLNDSQAPK

SEQ ID NO: 205 - protein, 58 aa, ARTIFICIAL SEQUENCE
  Engineered IL6 binding polypeptide
VDAKYAKEEQKAWTEIHLLPNLTVHQIAAFISKLFDDPSQSSELLSEAKKLNDSQAPK

SEQ ID NO: 206 - protein, 58 aa, ARTIFICIAL SEQUENCE
  Engineered IL6 binding polypeptide
VDAKYAKEERAAWREIHLLPNLTTEQRTAFISKLFDDPSQSSELLSEAKKLNDSQAPK

SEQ ID NO: 207 - protein, 58 aa, ARTIFICIAL SEQUENCE
  Engineered IL6 binding polypeptide
VDAKYAKEEQDAWREIHLLPNLTINQIVAFIQKLFDDPSQSSELLSEAKKLNDSQAPK

SEQ ID NO: 208 - protein, 58 aa, ARTIFICIAL SEQUENCE
  Engineered IL6 binding polypeptide
VDAKYAKEEREAWYEIHSLPNLTVTQIAAFISKLFDDPSQSSELLSEAKKLNDSQAPK

SEQ ID NO: 209 - protein, 58 aa, ARTIFICIAL SEQUENCE
  Engineered IL6 binding polypeptide
VDAKYAKEEATAWYEIHILPNLTVDQMAAFISKLFDDPSQSSELLSEAKKLNDSQAPK

SEQ ID NO: 210 - protein, 58 aa, ARTIFICIAL SEQUENCE
  Engineered IL6 binding polypeptide
VDAKYAKEERDAWYEIHKLPNLTANQMAAFISKLFDDPSQSSELLSEAKKLNDSQAPK

SEQ ID NO: 211 - protein, 58 aa, ARTIFICIAL SEQUENCE
  Engineered IL6 binding polypeptide
VDAKYAKEERDAWFEIHALPNLTVHQMTAFIIKLFDDPSQSSELLSEAKKLNDSQAPK

SEQ ID NO: 212 - protein, 58 aa, ARTIFICIAL SEQUENCE
  Engineered IL6 binding polypeptide
VDAKYAKEEREAWSEIHKLPNLTVDQMAAFISKLFDDPSQSSELLSEAKKLNDSQAPK

SEQ ID NO: 213 - protein, 58 aa, ARTIFICIAL SEQUENCE
  Engineered IL6 binding polypeptide
VDAKYAKEEREAWFEIHLLPNLTVDQMAAFISKLFDDPSQSSELLSEAKKLNDSQAPK

SEQ ID NO: 214 - protein, 58 aa, ARTIFICIAL SEQUENCE
  Engineered IL6 binding polypeptide
VDAKYAKEERKAWYEIHLLPNLTVQQMAAFISKLFDDPSQSSELLSEAKKLNDSQAPK

SEQ ID NO: 215 - protein, 58 aa, ARTIFICIAL SEQUENCE
  Engineered IL6 binding polypeptide
VDAKYAKEEREAWYEIHSLPNLTVNQVAAFIQKLFDDPSQSSELLSEAKKLNDSQAPK

SEQ ID NO: 216 - protein, 58 aa, ARTIFICIAL SEQUENCE
  Engineered IL6 binding polypeptide
VDAKYAKEERHAWREIHLLPNLTTEQRVAFIIKLFDDPSQSSELLSEAKKLNDSQAPK

SEQ ID NO: 217 - protein, 58 aa, ARTIFICIAL SEQUENCE
  Engineered IL6 binding polypeptide
VDAKYAKEEREAWTEIHSLPNLTVDQVTAFISKLFDDPSQSSELLSEAKKLNDSQAPK

SEQ ID NO: 218 - protein, 58 aa, ARTIFICIAL SEQUENCE
  Engineered IL6 binding polypeptide
VDAKYAKEERDAWWEIHLLPNLTVNQISAFISKLFDDPSQSSELLSEAKKLNDSQAPK

SEQ ID NO: 219 - protein, 58 aa, ARTIFICIAL SEQUENCE
  Engineered IL6 binding polypeptide
VDAKYAKEEHHAWREIHLLPNLTVEQMAAFISKLFDDPSQSSELLSEAKKLNDSQAPK

SEQ ID NO: 220 - protein, 58 aa, ARTIFICIAL SEQUENCE
  Engineered IL6 binding polypeptide
VDAKYAKEEQQAWHEIHLLPNLTVDQMAAFISKLFDDPSQSSELLSEAKKLNDSQAPK

SEQ ID NO: 221 - protein, 58 aa, ARTIFICIAL SEQUENCE
  Engineered IL6 binding polypeptide
VDAKYAKEEAQAWHEIHLLPNLTIHQMSAFISKLFDDPSQSSELLSEAKKLNDSQAPK

SEQ ID NO: 222 - protein, 58 aa, ARTIFICIAL SEQUENCE
  Engineered IL6 binding polypeptide
VDAKYAKEEAKAWWEIHVLPNLTIDQIAAFISKLFDDPSQSSELLSEAKKLNDSQAPK

SEQ ID NO: 223 - protein, 58 aa, ARTIFICIAL SEQUENCE
  Engineered IL6 binding polypeptide
VDAKYAKEEAQAWHEIHTLPNLTTEQMAAFISKLFDDPSQSSELLSEAKKLNDSQAPK

SEQ ID NO: 224 - protein, 58 aa, ARTIFICIAL SEQUENCE
  Engineered IL6 binding polypeptide
VDAKYAKEERDAWSEIHSLPNLTISQMAAFISKLFDDPSQSSELLSEAKKLNDSQAPK

SEQ ID NO: 225 - protein, 58 aa, ARTIFICIAL SEQUENCE
  Engineered IL6 binding polypeptide
VDAKYAKEERKAWHEIHILPNLTAEQLAAFISKLFDDPSQSSELLSEAKKLNDSQAPK

SEQ ID NO: 226 - protein, 58 aa, ARTIFICIAL SEQUENCE
  Engineered IL6 binding polypeptide
VDAKYAKEEADAWREIHVLPNLTTQQITAFIQKLFDDPSQSSELLSEAKKLNDSQAPK

SEQ ID NO: 227 - protein, 58 aa, ARTIFICIAL SEQUENCE
  Engineered IL6 binding polypeptide
VDAKYAKEERSAWTEIHMLPNLTVQQRAAFISKLFDDPSQSSELLSEAKKLNDSQAPK

SEQ ID NO: 228 - protein, 58 aa, ARTIFICIAL SEQUENCE
  Engineered IL6 binding polypeptide
VDAKYAKEEREAWYEIHLLPNLTIDQMSAFISKLFDDPSQSSELLSEAKKLNDSQAPK

SEQ ID NO: 229 - protein, 58 aa, ARTIFICIAL SEQUENCE
  Engineered IL6 binding polypeptide
VDAKYAKEEREAWYEIHLLPNLTVEQIVAFISKLFDDPSQSSELLSEAKKLNDSQAPK

SEQ ID NO: 230 - protein, 58 aa, ARTIFICIAL SEQUENCE
  Engineered IL6 binding polypeptide
VDAKYAKEERKAWFEIHSLPNLTVNQMAAFIQKLFDDPSQSSELLSEAKKLNDSQAPK

SEQ ID NO: 231 - protein, 58 aa, ARTIFICIAL SEQUENCE
  Engineered IL6 binding polypeptide
VDAKYAKEEADAWFEIHLLPNLTIDQVSAFISKLFDDPSQSSELLSEAKKLNDSQAPK

SEQ ID NO: 232 - protein, 58 aa, ARTIFICIAL SEQUENCE
  Engineered IL6 binding polypeptide
VDAKYAKEERDAWFEIHLLPNLTIEQMAAFISKLFDDPSQSSELLSEAKKLNDSQAPK

SEQ ID NO: 233 - protein, 58 aa, ARTIFICIAL SEQUENCE
  Engineered IL6 binding polypeptide
VDAKYAKEEADAWREIHTLPNLTVDQMSAFISKLFDDPSQSSELLSEAKKLNDSQAPK

SEQ ID NO: 234 - protein, 58 aa, ARTIFICIAL SEQUENCE
  Engineered IL6 binding polypeptide
VDAKYAKEERVAWYEIHMLPNLTINQMAAFISKLFDDPSQSSELLSEAKKLNDSQAPK

SEQ ID NO: 235 - protein, 58 aa, ARTIFICIAL SEQUENCE
  Engineered IL6 binding polypeptide
VDAKYAKEERDAWYEIHLLPNLTVNQMAAFISKLFDDPSQSSELLSEAKKLNDSQAPK

SEQ ID NO: 236 - protein, 58 aa, ARTIFICIAL SEQUENCE
  Engineered IL6 binding polypeptide
VDAKYAKEERDAWWEIHSLPNLTTQQMAAFIIKLYDDPSQSSELLSEAKKLNDSQAPK

SEQ ID NO: 237 - protein, 58 aa, ARTIFICIAL SEQUENCE
  Engineered IL6 binding polypeptide
VDAKYAKEEARAWHEIHTLPNLTIEQMAAFISKLFDDPSQSSELLSEAKKLNDSQAPK

SEQ ID NO: 238 - protein, 58 aa, ARTIFICIAL SEQUENCE
  Engineered IL6 binding polypeptide
VDAKYAKEERAAWYEIHLLPNLTVEQTAAFISKLFDDPSQSSELLSEAKKLNDSQAPK

SEQ ID NO: 239 - protein, 58 aa, ARTIFICIAL SEQUENCE
  Engineered IL6 binding polypeptide
VDAKYAKEEREAWYEIHLLPNLTVEQIAAFISKLFDDPSQSSELLSEAKKLNDSQAPK

SEQ ID NO: 240 - protein, 58 aa, ARTIFICIAL SEQUENCE
  Engineered IL6 binding polypeptide
VDAKYAKEEQHAWREIHLLPNLTTDQMAAFIQKLFDDPSQSSELLSEAKKLNDSQAPK

SEQ ID NO: 241 - protein, 58 aa, ARTIFICIAL SEQUENCE
  Engineered IL6 binding polypeptide
VDAKYAKEEASAWWEIHLLPNLTTTQRAAFISKLFDDPSQSSELLSEAKKLNDSQAPK

SEQ ID NO: 242 - protein, 58 aa, ARTIFICIAL SEQUENCE
  Engineered IL6 binding polypeptide
VDAKYAKEEATAWYEIHALPNLTVDQMVAFISKLFDDPSQSSELLSEAKKLNDSQAPK

SEQ ID NO: 243 - protein, 58 aa, ARTIFICIAL SEQUENCE
  Engineered IL6 binding polypeptide
VDAKYAKEEHKAWTEIHLLPNLTVSQISAFISKLFDDPSQSSELLSEAKKLNDSQAPK

SEQ ID NO: 244 - protein, 58 aa, ARTIFICIAL SEQUENCE
  Engineered IL6 binding polypeptide
VDAKYAKEEQAAWREIHTLPNLTIEQIAAFISKLFDDPSQSSELLSEAKKLNDSQAPK

SEQ ID NO: 245 - protein, 58 aa, ARTIFICIAL SEQUENCE
  Engineered IL6 binding polypeptide
VDAKYAKEERAAWFEIHTLPNLTVNQMAAFISKLFDDPSQSSELLSEAKKLNDSQAPK

SEQ ID NO: 246 - protein, 58 aa, ARTIFICIAL SEQUENCE
  Engineered IL6 binding polypeptide
VDAKYAKEEAAAWFEIHALPNLTVNQMAAFISKLFDDPSQSSELLSEAKKLNDSQAPK

SEQ ID NO: 247 - protein, 58 aa, ARTIFICIAL SEQUENCE
  Engineered IL6 binding polypeptide
VDAKYAKEEAKAWFEIHKLPNLTAEQISAFIIKLFDDPSQSSELLSEAKKLNDSQAPK

SEQ ID NO: 248 - protein, 58 aa, ARTIFICIAL SEQUENCE
  Engineered IL6 binding polypeptide
VDAKYAKEEREAWYEIHLLPNLTVQQIVAFIIKLFDDPSQSSELLSEAKKLNDSQAPK

SEQ ID NO: 249 - protein, 58 aa, ARTIFICIAL SEQUENCE
  Engineered IL6 binding polypeptide
VDAKYAKEEQQAWYEIHLLPNLTIEQMAAFISKLFDDPSQSSELLSEAKKLNDSQAPK

SEQ ID NO: 250 - protein, 58 aa, ARTIFICIAL SEQUENCE
  Engineered IL6 binding polypeptide
VDAKYAKEERDAWFEIHSLPNLTVDQMVAFISKLFDDPSQSSELLSEAKKLNDSQAPK

SEQ ID NO: 251 - protein, 58 aa, ARTIFICIAL SEQUENCE
  Engineered IL6 binding polypeptide
VDAKYAKEEAEAWFEIHTLPNLTVQQMAAFISKLFDDPSQSSELLSEAKKLNDSQAPK

SEQ ID NO: 252 - protein, 58 aa, ARTIFICIAL SEQUENCE
  Engineered IL6 binding polypeptide
VDAKYAKEEQKAWHEIHKLPNLTVDQTTAFISKLFDDPSQSSELLSEAKKLNDSQAPK

SEQ ID NO: 253 - protein, 58 aa, ARTIFICIAL SEQUENCE
  Engineered IL6 binding polypeptide
VDAKYAKEEREAWYEIHLLPNLTIEQMVAFISKLFDDPSQSSELLSEAKKLNDSQAPK

SEQ ID NO: 254 - protein, 58 aa, ARTIFICIAL SEQUENCE
  Engineered IL6 binding polypeptide
VDAKYAKEEAEAWFEIHTLPNLTVDQMAAFIVKLYDDPSQSSELLSEAKKLNDSQAPK

SEQ ID NO: 255 - protein, 58 aa, ARTIFICIAL SEQUENCE
  Engineered IL6 binding polypeptide
VDAKYAKEEAEAWFEIHTLPNLTVTQIAAFISKLFDDPSQSSELLSEAKKLNDSQAPK

SEQ ID NO: 256 - protein, 58 aa, ARTIFICIAL SEQUENCE
  Engineered IL6 binding polypeptide
VDAKYAKEERQAWYEIHALPNLTADQMAAFIQKLFDDPSQSSELLSEAKKLNDSQAPK

SEQ ID NO: 257 - protein, 58 aa, ARTIFICIAL SEQUENCE
  Engineered IL6 binding polypeptide
VDAKYAKEEQSAWYEIHALPNLTVQQMEAFISKLFDDPSQSSELLSEAKKLNDSQAPK

SEQ ID NO: 258 - protein, 58 aa, ARTIFICIAL SEQUENCE
  Engineered IL6 binding polypeptide
VDAKYAKEEADAWLEIHLLPNLTVEQMAAFISKLFDDPSQSSELLSEAKKLNDSQAPK

SEQ ID NO: 259 - protein, 58 aa, ARTIFICIAL SEQUENCE
  Engineered IL6 binding polypeptide
VDAKYAKEEQQAWWEIHTLPNLTVDQRSAFIVKLYDDPSQSSELLSEAKKLNDSQAPK

SEQ ID NO: 260 - protein, 58 aa, ARTIFICIAL SEQUENCE
  Engineered IL6 binding polypeptide
VDAKYAKEERKAWHEIHILPNLTVNQISAFIQKLFDDPSQSSELLSEAKKLNDSQAPK

SEQ ID NO: 261 - protein, 58 aa, ARTIFICIAL SEQUENCE
  Engineered IL6 binding polypeptide
VDAKYAKEEAHAWWEIHKLPNLTTDQTAAFISKLFDDPSQSSELLSEAKKLNDSQAPK

SEQ ID NO: 262 - protein, 58 aa, ARTIFICIAL SEQUENCE
  Engineered IL6 binding polypeptide
VDAKYAKEERDAWYEIHILPNLTVTQMAAFISKLFDDPSQSSELLSEAKKLNDSQAPK

SEQ ID NO: 263 - protein, 58 aa, ARTIFICIAL SEQUENCE
  Engineered IL6 binding polypeptide
VDAKYAKEEAQAWREIHTLPNLTAQQMAAFISKLFDDPSQSSELLSEAKKLNDSQAPK

SEQ ID NO: 264 - protein, 58 aa, ARTIFICIAL SEQUENCE
  Engineered IL6 binding polypeptide
VDAKYAKEERRAWHEIHVLPNLTVEQMAAFISKLFDDPSQSSELLSEAKKLNDSQAPK

SEQ ID NO: 265 - protein, 58 aa, ARTIFICIAL SEQUENCE
  Engineered IL6 binding polypeptide
VDAKYAKEEREAWSEIHLLPNLTVTQMAAFISKLFDDPSQSSELLSEAKKLNDSQAPK

SEQ ID NO: 266 - protein, 58 aa, ARTIFICIAL SEQUENCE
  Engineered IL6 binding polypeptide
VDAKYAKEERKAWYEIHLLPNLTVSQMAAFISKLFDDPSQSSELLSEAKKLNDSQAPK

SEQ ID NO: 267 - protein, 58 aa, ARTIFICIAL SEQUENCE
  Engineered IL6 binding polypeptide
VDAKYAKEEARAWYEIHLLPNLTVTQMAAFISKLFDDPSQSSELLSEAKKLNDSQAPK

SEQ ID NO: 268 - protein, 58 aa, ARTIFICIAL SEQUENCE
  Engineered IL6 binding polypeptide
VDAKYAKEEHEAWTEIHKLPNLTTEQMAAFISKLFDDPSQSSELLSEAKKLNDSQAPK

SEQ ID NO: 269 - protein, 58 aa, ARTIFICIAL SEQUENCE
  Engineered IL6 binding polypeptide
VDAKYAKEERDAWFEIHSLPNLTVQQMAAFISKLFDDPSQSSELLSEAKKLNDSQAPK

SEQ ID NO: 270 - protein, 58 aa, ARTIFICIAL SEQUENCE
  Engineered IL6 binding polypeptide
VDAKYAKEEQSAWHEIHLLPNLTVDQIAAFISKLFDDPSQSSELLSEAKKLNDSQAPK

SEQ ID NO: 271 - protein, 58 aa, ARTIFICIAL SEQUENCE
  Engineered IL6 binding polypeptide
VDAKYAKEEQAAWYEIHALPNLTVDQMTAFISKLFDDPSQSSELLSEAKKLNDSQAPK

SEQ ID NO: 272 - protein, 58 aa, ARTIFICIAL SEQUENCE
  Engineered IL6 binding polypeptide
VDAKYAKEEAAAWREIHLLPNLTTQQMAAFISKLFDDPSQSSELLSEAKKLNDSQAPK

SEQ ID NO: 273 - protein, 58 aa, ARTIFICIAL SEQUENCE
  Engineered IL6 binding polypeptide
VDAKYAKEEREAWYEIHILPNLTVEQMAAFISKLFDDPSQSSELLSEAKKLNDSQAPK

SEQ ID NO: 274 - protein, 58 aa, ARTIFICIAL SEQUENCE
  Engineered IL6 binding polypeptide
VDAKYAKEERKAWYEIHTLPNLTVDQMAAFISKLFDDPSQSSELLSEAKKLNDSQAPK

SEQ ID NO: 275 - protein, 58 aa, ARTIFICIAL SEQUENCE
  Engineered IL6 binding polypeptide
VDAKYAKEEAKAWREIHLLPNLTVEQMAAFISKLFDDPSQSSELLSEAKKLNDSQAPK

SEQ ID NO: 276 - protein, 58 aa, ARTIFICIAL SEQUENCE
  Engineered IL6 binding polypeptide
VDAKYAKEEAQAWSEIHMLPNLTVTQIAAFISKLFDDPSQSSELLSEAKKLNDSQAPK

SEQ ID NO: 277 - protein, 58 aa, ARTIFICIAL SEQUENCE
  Engineered IL6 binding polypeptide
VDAKYAKEEAHAWHEIHILPNLTVDQMSAFISKLFDDPSQSSELLSEAKKLNDSQAPK

SEQ ID NO: 278 - protein, 58 aa, ARTIFICIAL SEQUENCE
  Engineered IL6 binding polypeptide
VDAKYAKEEREAWFEIHLLPNLTVEQIAAFISKLFDDPSQSSELLSEAKKLNDSQAPK

SEQ ID NO: 279 - protein, 58 aa, ARTIFICIAL SEQUENCE
  Engineered IL6 binding polypeptide
VDAKYAKEERKAWWEIHLLPNLTIEQMAAFISKLFDDPSQSSELLSEAKKLNDSQAPK

SEQ ID NO: 280 - protein, 58 aa, ARTIFICIAL SEQUENCE
  Engineered IL6 binding polypeptide
VDAKYAKEERDAWYEIHTLPNLTVEQMVAFISKLFDDPSQSSELLSEAKKLNDSQAPK

SEQ ID NO: 281 - protein, 58 aa, ARTIFICIAL SEQUENCE
  Engineered IL6 binding polypeptide
VDAKYAKEERKAWYEIHALPNLTVSQMAAFIIKLYDDPSQSSELLSEAKKLNDSQAPK

SEQ ID NO: 282 - protein, 58 aa, ARTIFICIAL SEQUENCE
  Engineered IL6 binding polypeptide
VDAKYAKEEHKAWWEIHALPNLTISQITAFISKLFDDPSQSSELLSEAKKLNDSQAPK

SEQ ID NO: 283 - protein, 58 aa, ARTIFICIAL SEQUENCE
  Engineered IL6 binding polypeptide
VDAKYAKEEAQAWYEIHLLPNLTIEQMAAFISKLFDDPSQSSELLSEAKKLNDSQAPK

SEQ ID NO: 284 - protein, 58 aa, ARTIFICIAL SEQUENCE
  Engineered IL6 binding polypeptide
VDAKYAKEEQDAWWEIHALPNLTIDQMAAFISKLFDDPSQSSELLSEAKKLNDSQAPK

SEQ ID NO: 285 - protein, 58 aa, ARTIFICIAL SEQUENCE
  Engineered IL6 binding polypeptide
VDAKYAKEEHDAWWEIHILPNLTVEQIAAFISKLFDDPSQSSELLSEAKKLNDSQAPK

SEQ ID NO: 286 - protein, 58 aa, ARTIFICIAL SEQUENCE
  Engineered IL6 binding polypeptide
VDAKYAKEEARAWLEIHTLPNLTITQRAAFISKLFDDPSQSSELLSEAKKLNDSQAPK

SEQ ID NO: 287 - protein, 58 aa, ARTIFICIAL SEQUENCE
  Engineered IL6 binding polypeptide
VDAKYAKEERKAWHEIHILPNLTINQRAAFISKLFDDPSQSSELLSEAKKLNDSQAPK

SEQ ID NO: 288 - protein, 58 aa, ARTIFICIAL SEQUENCE
  Engineered IL6 binding polypeptide
VDAKYAKEEREAWYEIHMLPNLTVTQMAAFISKLFDDPSQSSELLSEAKKLNDSQAPK

SEQ ID NO: 289 - protein, 58 aa, ARTIFICIAL SEQUENCE
  Engineered IL6 binding polypeptide
VDAKYAKEERDAWFEIHILPNLTIHQMAAFISKLFDDPSQSSELLSEAKKLNDSQAPK

SEQ ID NO: 290 - protein, 58 aa, ARTIFICIAL SEQUENCE
  Engineered IL6 binding polypeptide
VDAKYAKEEHDAWYEIHTLPNLTVDQMVAFISKLFDDPSQSSELLSEAKKLNDSQAPK

SEQ ID NO: 291 - protein, 58 aa, ARTIFICIAL SEQUENCE
  Engineered IL6 binding polypeptide
VDAKYAKEEAQAWYEIHTLPNLTVDQMAAFISKLFDDPSQSSELLSEAKKLNDSQAPK

SEQ ID NO: 292 - protein, 58 aa, ARTIFICIAL SEQUENCE
  Engineered IL6 binding polypeptide
VDAKYAKEERVAWWEIHSLPNLTIDQRSAFISKLFDDPSQSSELLSEAKKLNDSQAPK

SEQ ID NO: 293 - protein, 58 aa, ARTIFICIAL SEQUENCE
  Engineered IL6 binding polypeptide
VDAKYAKEEHEAWTEIHLLPNLTVSQIAAFISKLFDDPSQSSELLSEAKKLNDSQAPK

SEQ ID NO: 294 - protein, 58 aa, ARTIFICIAL SEQUENCE
  Engineered IL6 binding polypeptide
VDAKYAKEEAQAWREIHLLPNLTVDQIAAFISKLFDDPSQSSELLSEAKKLNDSQAPK

SEQ ID NO: 295 - protein, 58 aa, ARTIFICIAL SEQUENCE
  Engineered IL6 binding polypeptide
VDAKYAKEERDAWHEIHVLPNLTAEQMSAFISKLFDDPSQSSELLSEAKKLNDSQAPK

SEQ ID NO: 296 - protein, 58 aa, ARTIFICIAL SEQUENCE
  Engineered IL6 binding polypeptide
VDAKYAKEEATAWFEIHTLPNLTVDQMAAFIIKLFDDPSQSSELLSEAKKLNDSQAPK

SEQ ID NO: 297 - protein, 58 aa, ARTIFICIAL SEQUENCE
  Engineered IL6 binding polypeptide
VDAKYAKEERHAWFEIHTLPNLTVTQMAAFISKLFDDPSQSSELLSEAKKLNDSQAPK

SEQ ID NO: 298 - protein, 58 aa, ARTIFICIAL SEQUENCE
  Engineered IL6 binding polypeptide
VDAKYAKEEREAWWEIHALPNLTTNQVAAFISKLFDDPSQSSELLSEAKKLNDSQAPK

SEQ ID NO: 299 - protein, 58 aa, ARTIFICIAL SEQUENCE
  Engineered IL6 binding polypeptide
VDAKYAKEERRAWWEIHLLPNLTIQQIAAFISKLFDDPSQSSELLSEAKKLNDSQAPK

SEQ ID NO: 300 - protein, 58 aa, ARTIFICIAL SEQUENCE
  Engineered IL6 binding polypeptide
VDAKYAKEEAHAWFEIHILPNLTIDQMAAFISKLFDDPSQSSELLSEAKKLNDSQAPK

SEQ ID NO: 301 - protein, 58 aa, ARTIFICIAL SEQUENCE
  Engineered IL6 binding polypeptide
VDAKYAKEEARAWREIHLLPNLTVEQMAAFISKLFDDPSQSSELLSEAKKLNDSQAPK

SEQ ID NO: 302 - protein, 58 aa, ARTIFICIAL SEQUENCE
  Engineered IL6 binding polypeptide
VDAKYAKEERRAWYEIHTLPNLTVEQLSAFISKLFDDPSQSSELLSEAKKLNDSQAPK

SEQ ID NO: 303 - protein, 58 aa, ARTIFICIAL SEQUENCE
  Engineered IL6 binding polypeptide
VDAKYAKEEAHAWHEIHVLPNLTVEQIAAFISKLFDDPSQSSELLSEAKKLNDSQAPK

SEQ ID NO: 304 - protein, 58 aa, ARTIFICIAL SEQUENCE
  Engineered IL6 binding polypeptide
VDAKYAKEEREAWFEIHTLPNLTVEQMAAFISKLFDDPSQSSELLSEAKKLNDSQAPK

SEQ ID NO: 305 - protein, 58 aa, ARTIFICIAL SEQUENCE
  Engineered IL6 binding polypeptide
VDAKYAKEERDAWWEIHSLPNLTIDQMAAFISKLFDDPSQSSELLSEAKKLNDSQAPK

SEQ ID NO: 306 - protein, 58 aa, ARTIFICIAL SEQUENCE
  Engineered IL6 binding polypeptide
VDAKYAKEEARAWHEIHILPNLTIQQITAFIQKLFDDPSQSSELLSEAKKLNDSQAPK

SEQ ID NO: 307 - protein, 58 aa, ARTIFICIAL SEQUENCE
  Engineered IL6 binding polypeptide
VDAKYAKEEQKAWHEIHLLPNLTINQIVAFISKLFDDPSQSSELLSEAKKLNDSQAPK

SEQ ID NO: 308 - protein, 58 aa, ARTIFICIAL SEQUENCE
  Engineered IL6 binding polypeptide
VDAKYAKEEREAWYEIHILPNLTVNQVAAFISKLFDDPSQSSELLSEAKKLNDSQAPK

SEQ ID NO: 309 - protein, 58 aa, ARTIFICIAL SEQUENCE
  Engineered IL6 binding polypeptide
VDAKYAKEERVAWYEIHALPNLTVTQMAAFISKLFDDPSQSSELLSEAKKLNDSQAPK

SEQ ID NO: 310 - protein, 58 aa, ARTIFICIAL SEQUENCE
  Engineered IL6 binding polypeptide
VDAKYAKEERVAWLEIHALPNLTVDQMAAFIIKLFDDPSQSSELLSEAKKLNDSQAPK

SEQ ID NO: 311 - protein, 58 aa, ARTIFICIAL SEQUENCE
  Engineered IL6 binding polypeptide
VDAKYAKEERDAWFEIHMLPNLTVNQMAAFIIKLFDDPSQSSELLSEAKKLNDSQAPK

SEQ ID NO: 312 - protein, 58 aa, ARTIFICIAL SEQUENCE
  Engineered IL6 binding polypeptide
VDAKYAKEEAVAWFEIHTLPNLTVEQMAAFIVKLFDDPSQSSELLSEAKKLNDSQAPK

SEQ ID NO: 313 - protein, 58 aa, ARTIFICIAL SEQUENCE
  Engineered IL6 binding polypeptide
VDAKYAKEEQDAWSEIHLLPNLTVNQMAAFISKLFDDPSQSSELLSEAKKLNDSQAPK

SEQ ID NO: 314 - protein, 58 aa, ARTIFICIAL SEQUENCE
  Engineered IL6 binding polypeptide
VDAKYAKEERDAWWEIHALPNLTVDQMVAFISKLFDDPSQSSELLSEAKKLNDSQAPK

SEQ ID NO: 315 - protein, 58 aa, ARTIFICIAL SEQUENCE
  Engineered IL6 binding polypeptide
VDAKYAKEEAHAWHEIHVLPNLTVHQVAAFISKLFDDPSQSSELLSEAKKLNDSQAPK

SEQ ID NO: 316 - protein, 58 aa, ARTIFICIAL SEQUENCE
  Engineered IL6 binding polypeptide
VDAKYAKEEREAWYEIHLLPNLTAEQMAAFISKLFDDPSQSSELLSEAKKLNDSQAPK

SEQ ID NO: 317 - protein, 58 aa, ARTIFICIAL SEQUENCE
  Engineered IL6 binding polypeptide
VDAKYAKEEQEAWYEIHILPNLTISQMAAFISKLFDDPSQSSELLSEAKKLNDSQAPK

SEQ ID NO: 318 - protein, 58 aa, ARTIFICIAL SEQUENCE
  Engineered IL6 binding polypeptide
VDAKYAKEERDAWYEIHTLPNLTVEQMAAFISKLFDDPSQSSELLSEAKKLNDSQAPK

SEQ ID NO: 319 - protein, 58 aa, ARTIFICIAL SEQUENCE
  Engineered IL6 binding polypeptide
VDAKYAKEERQAWTEIHLLPNLTVTQMAAFISKLFDDPSQSSELLSEAKKLNDSQAPK

SEQ ID NO: 320 - protein, 58 aa, ARTIFICIAL SEQUENCE
  Engineered IL6 binding polypeptide
VDAKYAKEERDAWLEIHLLPNLTVEQMAAFISKLFDDPSQSSELLSEAKKLNDSQAPK

SEQ ID NO: 321 - protein, 58 aa, ARTIFICIAL SEQUENCE
  Engineered IL6 binding polypeptide
VDAKYAKEEQRAWTEIHTLPNLTVDQMAAFISKLFDDPSQSSELLSEAKKLNDSQAPK

SEQ ID NO: 322 - protein, 58 aa, ARTIFICIAL SEQUENCE
  Engineered IL6 binding polypeptide
VDAKYAKEERKAWWEIHLLPNLTVDQITAFISKLFDDPSQSSELLSEAKKLNDSQAPK

SEQ ID NO: 323 - protein, 58 aa, ARTIFICIAL SEQUENCE
  Engineered IL6 binding polypeptide
VDAKYAKEEARAWHEIHILPNLTVDQIAAFISKLFDDPSQSSELLSEAKKLNDSQAPK

SEQ ID NO: 324 - protein, 58 aa, ARTIFICIAL SEQUENCE
  Engineered IL6 binding polypeptide
VDAKYAKEEREAWHEIHILPNLTVTQMAAFISKLFDDPSQSSELLSEAKKLNDSQAPK

SEQ ID NO: 325 - protein, 58 aa, ARTIFICIAL SEQUENCE
  Engineered IL6 binding polypeptide
VDAKYAKEEQDAWWEIHKLPNLTTHQVAAFISKLFDDPSQSSELLSEAKKLNDSQAPK

SEQ ID NO: 326 - protein, 58 aa, ARTIFICIAL SEQUENCE
  Engineered IL6 binding polypeptide
VDAKYAKEERRAWFEIHALPNLTTEQMAAFIWKLFDDPSQSSELLSEAKKLNDSQAPK

SEQ ID NO: 327 - protein, 58 aa, ARTIFICIAL SEQUENCE
  Engineered IL6 binding polypeptide
VDAKYAKEEAAAWFEIHTLPNLTIEQMSAFISKLFDDPSQSSELLSEAKKLNDSQAPK

SEQ ID NO: 328 - protein, 58 aa, ARTIFICIAL SEQUENCE
  Engineered IL6 binding polypeptide
VDAKYAKEEREAWFEIHLLPNLTIEQMAAFISKLFDDPSQSSELLSEAKKLNDSQAPK

SEQ ID NO: 329 - protein, 58 aa, ARTIFICIAL SEQUENCE
  Engineered IL6 binding polypeptide
VDAKYAKEERKAWYEIHTLPNLTVNQMAAFISKLFDDPSQSSELLSEAKKLNDSQAPK

SEQ ID NO: 330 - protein, 58 aa, ARTIFICIAL SEQUENCE
  Engineered IL6 binding polypeptide
VDAKYAKEERQAWLEIHLLPNLTIEQMAAFISKLFDDPSQSSELLSEAKKLNDSQAPK

SEQ ID NO: 331 - protein, 58 aa, ARTIFICIAL SEQUENCE
  Engineered IL6 binding polypeptide
VDAKYAKEEHHAWLEIHTLPNLTVDQMAAFISKLFDDPSQSSELLSEAKKLNDSQAPK

SEQ ID NO: 332 - protein, 58 aa, ARTIFICIAL SEQUENCE
  Engineered IL6 binding polypeptide
VDAKYAKEEQQAWWEIHKLPNLTVEQMTAFIIKLYDDPSQSSELLSEAKKLNDSQAPK

SEQ ID NO: 333 - protein, 58 aa, ARTIFICIAL SEQUENCE
  Engineered IL6 binding polypeptide
VDAKYAKEERKAWFEIHALPNLTVTQVAAFISKLFDDPSQSSELLSEAKKLNDSQAPK

SEQ ID NO: 334 - protein, 58 aa, ARTIFICIAL SEQUENCE
  Engineered IL6 binding polypeptide
VDAKYAKEEHRAWTEIHKLPNLTTQQMAAFISKLFDDPSQSSELLSEAKKLNDSQAPK

SEQ ID NO: 335 - protein, 58 aa, ARTIFICIAL SEQUENCE
  Engineered IL6 binding polypeptide
VDAKYAKEEAQAWHEIHILPNLTVDQMAAFISKLFDDPSQSSELLSEAKKLNDSQAPK

SEQ ID NO: 336 - protein, 58 aa, ARTIFICIAL SEQUENCE
  Engineered IL6 binding polypeptide
VDAKYAKEEQKAWFEIHLLPNLTVEQIAAFIQKLFDDPSQSSELLSEAKKLNDSQAPK

SEQ ID NO: 337 - protein, 58 aa, ARTIFICIAL SEQUENCE
  Engineered IL6 binding polypeptide
VDAKYAKEERHAWYEIHLLPNLTVRQMAAFISKLFDDPSQSSELLSEAKKLNDSQAPK

SEQ ID NO: 338 - protein, 58 aa, ARTIFICIAL SEQUENCE
  Engineered IL6 binding polypeptide
VDAKYAKEERDAWYEIHLLPNLTVNQIAAFISKLFDDPSQSSELLSEAKKLNDSQAPK

SEQ ID NO: 339 - protein, 58 aa, ARTIFICIAL SEQUENCE
  Engineered IL6 binding polypeptide
VDAKYAKEEAHAWWEIHALPNLTVDQMAAFISKLFDDPSQSSELLSEAKKLNDSQAPK

SEQ ID NO: 340 - protein, 58 aa, ARTIFICIAL SEQUENCE
  Engineered IL6 binding polypeptide
VDAKYAKEEADAWFEIHVLPNLTIQQIAAFISKLFDDPSQSSELLSEAKKLNDSQAPK

SEQ ID NO: 341 - protein, 58 aa, ARTIFICIAL SEQUENCE
  Engineered IL6 binding polypeptide
VDAKYAKEERRAWFEIHILPNLTINQMAAFISKLFDDPSQSSELLSEAKKLNDSQAPK

SEQ ID NO: 342 - protein, 58 aa, ARTIFICIAL SEQUENCE
  Engineered IL6 binding polypeptide
VDAKYAKEERKAWYEIHVLPNLTVRQMAAFIQKLFDDPSQSSELLSEAKKLNDSQAPK

SEQ ID NO: 343 - protein, 58 aa, ARTIFICIAL SEQUENCE
  Engineered IL6 binding polypeptide
VDAKYAKEERHAWHEIHILPNLTVDQISAFISKLFDDPSQSSELLSEAKKLNDSQAPK

SEQ ID NO: 344 - protein, 58 aa, ARTIFICIAL SEQUENCE
  Engineered IL6 binding polypeptide
VDAKYAKEERKAWLEIHLLPNLTVEQMAAFISKLFDDPSQSSELLSEAKKLNDSQAPK

SEQ ID NO: 345 - protein, 58 aa, ARTIFICIAL SEQUENCE
  Engineered IL6 binding polypeptide
VDAKYAKEEREAWWEIHKLPNLTVTQMAAFISKLFDDPSQSSELLSEAKKLNDSQAPK

SEQ ID NO: 346 - protein, 58 aa, ARTIFICIAL SEQUENCE
  Engineered IL6 binding polypeptide
VDAKYAKEERHAWYEIHTLPNLTVNQMAAFISKLFDDPSQSSELLSEAKKLNDSQAPK

SEQ ID NO: 347 - protein, 58 aa, ARTIFICIAL SEQUENCE
  Engineered IL6 binding polypeptide
VDAKYAKEERHAWYEIHVLPNLTVQQMAAFIQKLFDDPSQSSELLSEAKKLNDSQAPK

SEQ ID NO: 348 - protein, 58 aa, ARTIFICIAL SEQUENCE
  Engineered IL6 binding polypeptide
VDAKYAKEERHAWWEIHALPNLTVEQIAAFIQKLFDDPSQSSELLSEAKKLNDSQAPK

SEQ ID NO: 349 - protein, 58 aa, ARTIFICIAL SEQUENCE
  Engineered IL6 binding polypeptide
VDAKYAKEEAAAWHEIHILPNLTVSQIAAFISKLFDDPSQSSELLSEAKKLNDSQAPK

SEQ ID NO: 350 - protein, 58 aa, ARTIFICIAL SEQUENCE
  Engineered IL6 binding polypeptide
VDAKYAKEEASAWTEIHLLPNLTIDQMAAFIQKLFDDPSQSSELLSEAKKLNDSQAPK

SEQ ID NO: 351 - protein, 58 aa, ARTIFICIAL SEQUENCE
  Engineered IL6 binding polypeptide
VDAKYAKEEQSAWYEIHILPNLTVDQIAAFISKLFDDPSQSSELLSEAKKLNDSQAPK

SEQ ID NO: 352 - protein, 58 aa, ARTIFICIAL SEQUENCE
  Engineered IL6 binding polypeptide
VDAKYAKEEADAWYEIHLLPNLTVNQMAAFISKLFDDPSQSSELLSEAKKLNDSQAPK

SEQ ID NO: 353 - protein, 58 aa, ARTIFICIAL SEQUENCE
  Engineered IL6 binding polypeptide
VDAKYAKEEQRAWFEIHTLPNLTVNQMAAFISKLFDDPSQSSELLSEAKKLNDSQAPK

SEQ ID NO: 354 - protein, 58 aa, ARTIFICIAL SEQUENCE
  Engineered IL6 binding polypeptide
VDAKYAKEEAHAWYEIHILPNLTVSQIAAFISKLFDDPSQSSELLSEAKKLNDSQAPK

SEQ ID NO: 355 - protein, 58 aa, ARTIFICIAL SEQUENCE
  Engineered IL6 binding polypeptide
VDAKYAKEEAAAWREIHSLPNLTTEQMAAFIMKLFDDPSQSSELLSEAKKLNDSQAPK

SEQ ID NO: 356 - protein, 58 aa, ARTIFICIAL SEQUENCE
  Engineered IL6 binding polypeptide
VDAKYAKEEHQAWTEIHLLPNLTVQQITAFISKLFDDPSQSSELLSEAKKLNDSQAPK

SEQ ID NO: 357 - protein, 58 aa, ARTIFICIAL SEQUENCE
  Engineered IL6 binding polypeptide
VDAKYAKEERKAWYEIHSLPNLTVSQMAAFISKLFDDPSQSSELLSEAKKLNDSQAPK

SEQ ID NO: 358 - protein, 58 aa, ARTIFICIAL SEQUENCE
  Engineered IL6 binding polypeptide
VDAKYAKEEAHAWREIHVLPNLTVDQMAAFISKLFDDPSQSSELLSEAKKLNDSQAPK

SEQ ID NO: 359 - protein, 58 aa, ARTIFICIAL SEQUENCE
  Engineered IL6 binding polypeptide
VDAKYAKEEAKAWTEIHLLPNLTVHQIAAFISKLFDDPSQSSELLSEAKKLNDSQAPK

SEQ ID NO: 360 - protein, 58 aa, ARTIFICIAL SEQUENCE
  Engineered IL6 binding polypeptide
VDAKYAKEEREAWFEIHKLPNLTVTQMAAFIIKLFDDPSQSSELLSEAKKLNDSQAPK

SEQ ID NO: 361 - protein, 58 aa, ARTIFICIAL SEQUENCE
  Engineered IL6 binding polypeptide
VDAKYAKEEADAWYEIHILPNLTVSQMAAFISKLFDDPSQSSELLSEAKKLNDSQAPK

SEQ ID NO: 362 - protein, 58 aa, ARTIFICIAL SEQUENCE
  Engineered IL6 binding polypeptide
VDAKYAKEEARAWYEIHILPNLTVNQMAAFITKLFDDPSQSSELLSEAKKLNDSQAPK

SEQ ID NO: 363 - protein, 58 aa, ARTIFICIAL SEQUENCE
  Engineered IL6 binding polypeptide
VDAKYAKEEREAWFEIHLLPNLTITQMAAFISKLFDDPSQSSELLSEAKKLNDSQAPK

SEQ ID NO: 364 - protein, 58 aa, ARTIFICIAL SEQUENCE
  Engineered IL6 binding polypeptide
VDAKYAKEERDAWYEIHLLPNLTVTQMSAFISKLFDDPSQSSELLSEAKKLNDSQAPK

SEQ ID NO: 365 - protein, 58 aa, ARTIFICIAL SEQUENCE
  Engineered IL6 binding polypeptide
VDAKYAKEEHEAWLEIHALPNLTVEQMSAFIIKLYDDPSQSSELLSEAKKLNDSQAPK

SEQ ID NO: 366 - protein, 58 aa, ARTIFICIAL SEQUENCE
  Engineered IL6 binding polypeptide
VDAKYAKEEREAWFEIHLLPNLTVHQMAAFISKLFDDPSQSSELLSEAKKLNDSQAPK

SEQ ID NO: 367 - protein, 58 aa, ARTIFICIAL SEQUENCE
  Engineered IL6 binding polypeptide
VDAKYAKEEHQAWTEIHLLPNLTTEQMAAFIQKLFDDPSQSSELLSEAKKLNDSQAPK

SEQ ID NO: 368 - protein, 58 aa, ARTIFICIAL SEQUENCE
  Engineered IL6 binding polypeptide
VDAKYAKEEARAWYEIHVLPNLTTDQRSAFISKLFDDPSQSSELLSEAKKLNDSQAPK

SEQ ID NO: 369 - protein, 58 aa, ARTIFICIAL SEQUENCE
  Engineered IL6 binding polypeptide
VDAKYAKEERDAWFEIHTLPNLTVSQMAAFISKLFDDPSQSSELLSEAKKLNDSQAPK

SEQ ID NO: 370 - protein, 58 aa, ARTIFICIAL SEQUENCE
  Engineered IL6 binding polypeptide
VDAKYAKEERQAWFEIHSLPNLTVTQMAAFISKLFDDPSQSSELLSEAKKLNDSQAPK

SEQ ID NO: 371 - protein, 58 aa, ARTIFICIAL SEQUENCE
  Engineered IL6 binding polypeptide
VDAKYAKEERQAWWEIHALPNLTAEQVAAFISKLFDDPSQSSELLSEAKKLNDSQAPK

SEQ ID NO: 372 - protein, 58 aa, ARTIFICIAL SEQUENCE
  Engineered IL6 binding polypeptide
VDAKYAKEEAKAWYEIHTLPNLTVDQISAFIIKLFDDPSQSSELLSEAKKLNDSQAPK

SEQ ID NO: 373 - protein, 58 aa, ARTIFICIAL SEQUENCE
  Engineered IL6 binding polypeptide
VDAKYAKEEREAWWEIHLLPNLTVDQISAFISKLFDDPSQSSELLSEAKKLNDSQAPK

SEQ ID NO: 374 - protein, 58 aa, ARTIFICIAL SEQUENCE
  Engineered IL6 binding polypeptide
VDAKYAKEEADAWTEIHSLPNLTVEQMAAFIWKLLDDPSQSSELLSEAKKLNDSQAPK

SEQ ID NO: 375 - protein, 58 aa, ARTIFICIAL SEQUENCE
  Engineered IL6 binding polypeptide
VDAKYAKEERAAWWEIHTLPNLTTDQRSAFIIKLYDDPSQSSELLSEAKKLNDSQAPK

SEQ ID NO: 376 - protein, 58 aa, ARTIFICIAL SEQUENCE
  Engineered IL6 binding polypeptide
VDAKYAKEEHRAWTEIHLLPNLTTDQMAAFIIKLFDDPSQSSELLSEAKKLNDSQAPK

SEQ ID NO: 377 - protein, 58 aa, ARTIFICIAL SEQUENCE
  Engineered IL6 binding polypeptide
VDAKYAKEEADAWWEIHMLPNLTTEQRSAFISKLFDDPSQSSELLSEAKKLNDSQAPK

SEQ ID NO: 378 - protein, 58 aa, ARTIFICIAL SEQUENCE
  Engineered IL6 binding polypeptide
VDAKYAKEEREAWWEIHKLPNLTVEQVAAFISKLFDDPSQSSELLSEAKKLNDSQAPK

SEQ ID NO: 379 - protein, 58 aa, ARTIFICIAL SEQUENCE
  Engineered IL6 binding polypeptide
VDAKYAKEEAHAWWEIHALPNLTVHQMAAFISKLFDDPSQSSELLSEAKKLNDSQAPK

SEQ ID NO: 380 - protein, 58 aa, ARTIFICIAL SEQUENCE
  Engineered IL6 binding polypeptide
VDAKYAKEEAQAWREIHVLPNLTVQQIAAFISKLFDDPSQSSELLSEAKKLNDSQAPK

SEQ ID NO: 381 - protein, 58 aa, ARTIFICIAL SEQUENCE
  Engineered IL6 binding polypeptide
VDAKYAKEERHAWWEIHKLPNLTVEQVAAFISKLFDDPSQSSELLSEAKKLNDSQAPK

SEQ ID NO: 382 - protein, 58 aa, ARTIFICIAL SEQUENCE
  Engineered IL6 binding polypeptide
VDAKYAKEEAQAWWEIHKLPNLTVEQLAAFISKLFDDPSQSSELLSEAKKLNDSQAPK

SEQ ID NO: 383 - protein, 58 aa, ARTIFICIAL SEQUENCE
  Engineered IL6 binding polypeptide
VDAKYAKEERKAWYEIHTLPNLTTDQVAAFISKLFDDPSQSSELLSEAKKLNDSQAPK

SEQ ID NO: 384 - protein, 58 aa, ARTIFICIAL SEQUENCE
  Engineered IL6 binding polypeptide
VDAKYAKEEREAWHEIHLLPNLTIEQVAAFISKLFDDPSQSSELLSEAKKLNDSQAPK

SEQ ID NO: 385 - protein, 58 aa, ARTIFICIAL SEQUENCE
  Engineered IL6 binding polypeptide
VDAKYAKEEQKAWWEIHLLPNLTTEQMAAFISKLFDDPSQSSELLSEAKKLNDSQAPK

SEQ ID NO: 386 - protein, 58 aa, ARTIFICIAL SEQUENCE
  Engineered IL6 binding polypeptide
VDAKYAKEEQAAWLEIHLLPNLTVEQMAAFISKLFDDPSQSSELLSEAKKLNDSQAPK

SEQ ID NO: 387 - protein, 58 aa, ARTIFICIAL SEQUENCE
  Engineered IL6 binding polypeptide
VDAKYAKEEREAWWEIHALPNLTTNQMAAFISKLFDDPSQSSELLSEAKKLNDSQAPK

SEQ ID NO: 388 - protein, 58 aa, ARTIFICIAL SEQUENCE
  Engineered IL6 binding polypeptide
VDAKYAKEEAEAWYEIHILPNLTITQMAAFISKLFDDPSQSSELLSEAKKLNDSQAPK

SEQ ID NO: 389 - protein, 58 aa, ARTIFICIAL SEQUENCE
  Engineered IL6 binding polypeptide
VDAKYAKEERQAWYEIHLLPNLTIEQMAAFISKLFDDPSQSSELLSEAKKLNDSQAPK

SEQ ID NO: 390 - protein, 58 aa, ARTIFICIAL SEQUENCE
  Engineered IL6 binding polypeptide
VDAKYAKEEAKAWFEIHTLPNLTVTQMAAFISKLFDDPSQSSELLSEAKKLNDSQAPK

SEQ ID NO: 391 - protein, 58 aa, ARTIFICIAL SEQUENCE
  Engineered IL6 binding polypeptide
VDAKYAKEEADAWWEIHSLPNLTVDQTAAFISKLFDDPSQSSELLSEAKKLNDSQAPK

SEQ ID NO: 392 - protein, 58 aa, ARTIFICIAL SEQUENCE
  Engineered IL6 binding polypeptide
VDAKYAKEERVAWYEIHILPNLTVEQTAAFISKLFDDPSQSSELLSEAKKLNDSQAPK

SEQ ID NO: 393 - protein, 58 aa, ARTIFICIAL SEQUENCE
  Engineered IL6 binding polypeptide
VDAKYAKEERKAWYEIHTLPNLTVDQMSAFISKLFDDPSQSSELLSEAKKLNDSQAPK

SEQ ID NO: 394 - protein, 58 aa, ARTIFICIAL SEQUENCE
  Engineered IL6 binding polypeptide
VDAKYAKEEAQAWFEIHTLPNLTIEQMAAFIIKLYDDPSQSSELLSEAKKLNDSQAPK

SEQ ID NO: 395 - protein, 58 aa, ARTIFICIAL SEQUENCE
  Engineered IL6 binding polypeptide
VDAKYAKEERQAWYEIHALPNLTVDQMAAFIIKLYDDPSQSSELLSEAKKLNDSQAPK

SEQ ID NO: 396 - protein, 58 aa, ARTIFICIAL SEQUENCE
  Engineered IL6 binding polypeptide
VDAKYAKEEADAWFEIHVLPNLTTEQMTAFISKLFDDPSQSSELLSEAKKLNDSQAPK

SEQ ID NO: 397 - protein, 58 aa, ARTIFICIAL SEQUENCE
  Engineered IL6 binding polypeptide
VDAKYAKEERRAWFEIHALPNLTVEQMAAFISKLFDDPSQSSELLSEAKKLNDSQAPK

SEQ ID NO: 398 - protein, 58 aa, ARTIFICIAL SEQUENCE
  Engineered IL6 binding polypeptide
VDAKYAKEEAKAWYEIHSLPNLTVNQMAAFISKLFDDPSQSSELLSEAKKLNDSQAPK

SEQ ID NO: 399 - protein, 58 aa, ARTIFICIAL SEQUENCE
  Engineered IL6 binding polypeptide
VDAKYAKEEARAWHEIHTLPNLTVHQMAAFIQKLFDDPSQSSELLSEAKKLNDSQAPK

SEQ ID NO: 400 - protein, 58 aa, ARTIFICIAL SEQUENCE
  Engineered IL6 binding polypeptide
VDAKYAKEERRAWREIHTLPNLTVSQMAAFISKLFDDPSQSSELLSEAKKLNDSQAPK

SEQ ID NO: 401 - protein, 58 aa, ARTIFICIAL SEQUENCE
  Engineered IL6 binding polypeptide
VDAKYAKEERAAWYEIHLLPNLTISQMAAFISKLFDDPSQSSELLSEAKKLNDSQAPK

SEQ ID NO: 402 - protein, 58 aa, ARTIFICIAL SEQUENCE
  Engineered IL6 binding polypeptide
VDAKYAKEERKAWWEIHTLPNLTVSQMAAFISKLFDDPSQSSELLSEAKKLNDSQAPK

SEQ ID NO: 403 - protein, 58 aa, ARTIFICIAL SEQUENCE
  Engineered IL6 binding polypeptide
VDAKYAKEERHAWYEIHMLPNLTIEQITAFISKLFDDPSQSSELLSEAKKLNDSQAPK

SEQ ID NO: 404 - protein, 58 aa, ARTIFICIAL SEQUENCE
  Engineered IL6 binding polypeptide
VDAKYAKEEAQAWHEIHLLPNLTVEQMAAFIQKLFDDPSQSSELLSEAKKLNDSQAPK

SEQ ID NO: 405 - protein, 58 aa, ARTIFICIAL SEQUENCE
  Engineered IL6 binding polypeptide
VDAKYAKEERKAWYEIHMLPNLTVDQIAAFISKLFDDPSQSSELLSEAKKLNDSQAPK

SEQ ID NO: 406 - protein, 58 aa, ARTIFICIAL SEQUENCE
  Engineered IL6 binding polypeptide
VDAKYAKEEAHAWWEIHKLPNLTVEQVAAFISKLFDDPSQSSELLSEAKKLNDSQAPK

SEQ ID NO: 407 - protein, 58 aa, ARTIFICIAL SEQUENCE
  Engineered IL6 binding polypeptide
VDAKYAKEERKAWWEIHLLPNLTVNQMAAFISKLFDDPSQSSELLSEAKKLNDSQAPK

SEQ ID NO: 408 - protein, 58 aa, ARTIFICIAL SEQUENCE
  Engineered IL6 binding polypeptide
VDAKYAKEEREAWYEIHLLPNLTVSQMAAFISKLFDDPSQSSELLSEAKKLNDSQAPK

SEQ ID NO: 409 - protein, 58 aa, ARTIFICIAL SEQUENCE
  Engineered IL6 binding polypeptide
VDAKYAKEEAKAWHEIHILPNLTVDQMAAFISKLFDDPSQSSELLSEAKKLNDSQAPK

SEQ ID NO: 410 - protein, 58 aa, ARTIFICIAL SEQUENCE
  Engineered IL6 binding polypeptide
VDAKYAKEERHAWYEIHTLPNLTVEQMAAFIIKLFDDPSQSSELLSEAKKLNDSQAPK

SEQ ID NO: 411 - protein, 58 aa, ARTIFICIAL SEQUENCE
  Engineered IL6 binding polypeptide
VDAKYAKEERHAWTEIHKLPNLTVQQMAAFISKLFDDPSQSSELLSEAKKLNDSQAPK

SEQ ID NO: 412 - protein, 58 aa, ARTIFICIAL SEQUENCE
  Engineered IL6 binding polypeptide
VDAKYAKEERDAWHEIHTLPNLTVNQMAAFISKLFDDPSQSSELLSEAKKLNDSQAPK

SEQ ID NO: 413 - protein, 58 aa, ARTIFICIAL SEQUENCE
  Engineered IL6 binding polypeptide
VDAKYAKEEREAWYEIHLLPNLTTNQRSAFISKLFDDPSQSSELLSEAKKLNDSQAPK

SEQ ID NO: 414 - protein, 58 aa, ARTIFICIAL SEQUENCE
  Engineered IL6 binding polypeptide
VDAKYAKEEAVAWREIHLLPNLTVNQMAAFISKLFDDPSQSSELLSEAKKLNDSQAPK

SEQ ID NO: 415 - protein, 58 aa, ARTIFICIAL SEQUENCE
  Engineered IL6 binding polypeptide
VDAKYAKEERAAWTEIHLLPNLTVDQIAAFISKLFDDPSQSSELLSEAKKLNDSQAPK

SEQ ID NO: 416 - protein, 58 aa, ARTIFICIAL SEQUENCE
  Engineered IL6 binding polypeptide
VDAKYAKEEQAAWFEIHVLPNLTIEQRAAFISKLFDDPSQSSELLSEAKKLNDSQAPK

SEQ ID NO: 417 - protein, 58 aa, ARTIFICIAL SEQUENCE
  Engineered IL6 binding polypeptide
VDAKYAKEERTAWWEIHALPNLTVEQIAAFISKLFDDPSQSSELLSEAKKLNDSQAPK

SEQ ID NO: 418 - protein, 58 aa, ARTIFICIAL SEQUENCE
  Engineered IL6 binding polypeptide
VDAKYAKEEAEAWFEIHTLPNLTVDQRVAFIIKLFDDPSQSSELLSEAKKLNDSQAPK

SEQ ID NO: 419 - protein, 58 aa, ARTIFICIAL SEQUENCE
  Engineered IL6 binding polypeptide
VDAKYAKEEREAWFEIHTLPNLTINQMAAFIIKLFDDPSQSSELLSEAKKLNDSQAPK

SEQ ID NO: 420 - protein, 58 aa, ARTIFICIAL SEQUENCE
  Engineered IL6 binding polypeptide
VDAKYAKEERQAWFEIHALPNLTVQQRAAFISKLFDDPSQSSELLSEAKKLNDSQAPK

SEQ ID NO: 421 - protein, 58 aa, ARTIFICIAL SEQUENCE
  Engineered IL6 binding polypeptide
VDAKYAKEEREAWHEIHLLPNLTIDQLAAFISKLFDDPSQSSELLSEAKKLNDSQAPK

SEQ ID NO: 422 - protein, 58 aa, ARTIFICIAL SEQUENCE
  Engineered IL6 binding polypeptide
VDAKYAKEEHHAWWEIHALPNLTVDQVAAFIIKLYDDPSQSSELLSEAKKLNDSQAPK

SEQ ID NO: 423 - protein, 58 aa, ARTIFICIAL SEQUENCE
  Engineered IL6 binding polypeptide
VDAKYAKEEAKAWYEIHILPNLTVTQITAFISKLFDDPSQSSELLSEAKKLNDSQAPK

SEQ ID NO: 424 - protein, 58 aa, ARTIFICIAL SEQUENCE
  Engineered IL6 binding polypeptide
VDAKYAKEEQQAWFEIHTLPNLTVQQVTAFISKLFDDPSQSSELLSEAKKLNDSQAPK

SEQ ID NO: 425 - protein, 58 aa, ARTIFICIAL SEQUENCE
  Engineered IL6 binding polypeptide
VDAKYAKEERTAWWEIHTLPNLTVTQMAAFISKLFDDPSQSSELLSEAKKLNDSQAPK

SEQ ID NO: 426 - protein, 58 aa, ARTIFICIAL SEQUENCE
  Engineered IL6 binding polypeptide
VDAKYAKEERAAWYEIHLLPNLTVDQMSAFISKLFDDPSQSSELLSEAKKLNDSQAPK

SEQ ID NO: 427 - protein, 58 aa, ARTIFICIAL SEQUENCE
  Engineered IL6 binding polypeptide
VDAKYAKEEQQAWWEIHALPNLTVDQITAFISKLFDDPSQSSELLSEAKKLNDSQAPK

SEQ ID NO: 428 - protein, 58 aa, ARTIFICIAL SEQUENCE
  Engineered IL6 binding polypeptide
VDAKYAKEERRAWYEIHTLPNLTVSQMAAFIIKLFDDPSQSSELLSEAKKLNDSQAPK

SEQ ID NO: 429 - protein, 58 aa, ARTIFICIAL SEQUENCE
  Engineered IL6 binding polypeptide
VDAKYAKEEQRAWTEIHMLPNLTANQMAAFISKLFDDPSQSSELLSEAKKLNDSQAPK

SEQ ID NO: 430 - protein, 58 aa, ARTIFICIAL SEQUENCE
  Engineered IL6 binding polypeptide
VDAKYAKEEHEAWYEIHVLPNLTVNQISAFISKLFDDPSQSSELLSEAKKLNDSQAPK

SEQ ID NO: 431 - protein, 58 aa, ARTIFICIAL SEQUENCE
  Engineered IL6 binding polypeptide
VDAKYAKEEADAWHEIHLLPNLTVEQMAAFIQKLFDDPSQSSELLSEAKKLNDSQAPK

SEQ ID NO: 432 - protein, 58 aa, ARTIFICIAL SEQUENCE
  Engineered IL6 binding polypeptide
VDAKYAKEEREAWFEIHALPNLTVTQMAAFISKLFDDPSQSSELLSEAKKLNDSQAPK

SEQ ID NO: 433 - protein, 58 aa, ARTIFICIAL SEQUENCE
  Engineered IL6 binding polypeptide
VDAKYAKEERDAWYEIHLLPNLTVEQMAAFIQKLFDDPSQSSELLSEAKKLNDSQAPK

SEQ ID NO: 434 - protein, 58 aa, ARTIFICIAL SEQUENCE
  Engineered IL6 binding polypeptide
VDAKYAKEERKAWFEIHLLPNLTVTQMAAFISKLFDDPSQSSELLSEAKKLNDSQAPK

SEQ ID NO: 435 - protein, 58 aa, ARTIFICIAL SEQUENCE
  Engineered IL6 binding polypeptide
VDAKYAKEEAEAWSEIHLLPNLTVEQMAAFISKLFDDPSQSSELLSEAKKLNDSQAPK

SEQ ID NO: 436 - protein, 58 aa, ARTIFICIAL SEQUENCE
  Engineered IL6 binding polypeptide
VDAKYAKEERKAWYEIHSLPNLTVNQMAAFIIKLFDDPSQSSELLSEAKKLNDSQAPK

SEQ ID NO: 437 - protein, 58 aa, ARTIFICIAL SEQUENCE
  Engineered IL6 binding polypeptide
VDAKYAKEEAAAWHEIHVLPNLTVDQMAAFIIKLYDDPSQSSELLSEAKKLNDSQAPK

SEQ ID NO: 438 - protein, 58 aa, ARTIFICIAL SEQUENCE
  Engineered IL6 binding polypeptide
VDAKYAKEERHAWTEIHKLPNLTIQQITAFISKLFDDPSQSSELLSEAKKLNDSQAPK

SEQ ID NO: 439 - protein, 58 aa, ARTIFICIAL SEQUENCE
  Engineered IL6 binding polypeptide
VDAKYAKEERRAWFEIHALPNLTVQQMVAFISKLFDDPSQSSELLSEAKKLNDSQAPK

SEQ ID NO: 440 - protein, 58 aa, ARTIFICIAL SEQUENCE
  Engineered IL6 binding polypeptide
VDAKYAKEERDAWYEIHILPNLTVNQIAAFISKLFDDPSQSSELLSEAKKLNDSQAPK

SEQ ID NO: 441 - protein, 58 aa, ARTIFICIAL SEQUENCE
  Engineered IL6 binding polypeptide
VDAKYAKEEAEAWHEIHVLPNLTVNQMAAFISKLFDDPSQSSELLSEAKKLNDSQAPK

SEQ ID NO: 442 - protein, 58 aa, ARTIFICIAL SEQUENCE
  Engineered IL6 binding polypeptide
VDAKYAKEEARAWHEIHLLPNLTIQQMAAFISKLFDDPSQSSELLSEAKKLNDSQAPK

SEQ ID NO: 443 - protein, 58 aa, ARTIFICIAL SEQUENCE
  Engineered IL6 binding polypeptide
VDAKYAKEEAQAWWEIHALPNLTVDQTAAFIIKLFDDPSQSSELLSEAKKLNDSQAPK

SEQ ID NO: 444 - protein, 58 aa, ARTIFICIAL SEQUENCE
  Engineered IL6 binding polypeptide
VDAKYAKEEADAWFEIHTLPNLTVEQIAAFISKLFDDPSQSSELLSEAKKLNDSQAPK

SEQ ID NO: 445 - protein, 58 aa, ARTIFICIAL SEQUENCE
  Engineered IL6 binding polypeptide
VDAKYAKEEAAAWYEIHILPNLTVQQMAAFISKLFDDPSQSSELLSEAKKLNDSQAPK

SEQ ID NO: 446 - protein, 58 aa, ARTIFICIAL SEQUENCE
  Engineered IL6 binding polypeptide
VDAKYAKEEAEAWFEIHVLPNLTVSQIAAFISKLFDDPSQSSELLSEAKKLNDSQAPK

SEQ ID NO: 447 - protein, 58 aa, ARTIFICIAL SEQUENCE
  Engineered IL6 binding polypeptide
VDAKYAKEEQSAWYEIHLLPNLTTNQLTAFISKLFDDPSQSSELLSEAKKLNDSQAPK

SEQ ID NO: 448 - protein, 58 aa, ARTIFICIAL SEQUENCE
  Engineered IL6 binding polypeptide
VDAKYAKEEARAWYEIHTLPNLTATQMAAFISKLFDDPSQSSELLSEAKKLNDSQAPK

SEQ ID NO: 449 - protein, 58 aa, ARTIFICIAL SEQUENCE
  Engineered IL6 binding polypeptide
VDAKYAKEEADAWWEIHALPNLTVDQVTAFIIKLYDDPSQSSELLSEAKKLNDSQAPK

SEQ ID NO: 450 - protein, 58 aa, ARTIFICIAL SEQUENCE
  Engineered IL6 binding polypeptide
VDAKYAKEEAHAWREIHILPNLTVNQMAAFISKLFDDPSQSSELLSEAKKLNDSQAPK

SEQ ID NO: 451 - protein, 58 aa, ARTIFICIAL SEQUENCE
  Engineered IL6 binding polypeptide
VDAKYAKEEAQAWHEIHLLPNLTVHQMAAFISKLFDDPSQSSELLSEAKKLNDSQAPK

SEQ ID NO: 452 - protein, 58 aa, ARTIFICIAL SEQUENCE
  Engineered IL6 binding polypeptide
VDAKYAKEEARAWHEIHILPNLTTDQMAAFISKLFDDPSQSSELLSEAKKLNDSQAPK

SEQ ID NO: 453 - protein, 58 aa, ARTIFICIAL SEQUENCE
  Engineered IL6 binding polypeptide
VDAKYAKEERHAWHEIHILPNLTVDQMAAFISKLFDDPSQSSELLSEAKKLNDSQAPK

SEQ ID NO: 454 - protein, 58 aa, ARTIFICIAL SEQUENCE
  Engineered IL6 binding polypeptide
VDAKYAKEERHAWREIHLLPNLTVNQMAAFISKLFDDPSQSSELLSEAKKLNDSQAPK

SEQ ID NO: 455 - protein, 58 aa, ARTIFICIAL SEQUENCE
  Engineered IL6 binding polypeptide
VDAKYAKEERTAWWEIHALPNLTVSQVAAFISKLFDDPSQSSELLSEAKKLNDSQAPK

SEQ ID NO: 456 - protein, 58 aa, ARTIFICIAL SEQUENCE
  Engineered IL6 binding polypeptide
VDAKYAKEERHAWYEIHILPNLTVDQMAAFITKLFDDPSQSSELLSEAKKLNDSQAPK

SEQ ID NO: 457 - protein, 58 aa, ARTIFICIAL SEQUENCE
  Engineered IL6 binding polypeptide
VDAKYAKEEQRAWREIHLLPNLTVDQMAAFISKLFDDPSQSSELLSEAKKLNDSQAPK

SEQ ID NO: 458 - protein, 58 aa, ARTIFICIAL SEQUENCE
  Engineered IL6 binding polypeptide
VDAKYAKEERQAWYEIHVLPNLTVHQMAAFISKLFDDPSQSSELLSEAKKLNDSQAPK

SEQ ID NO: 459 - protein, 58 aa, ARTIFICIAL SEQUENCE
  Engineered IL6 binding polypeptide
VDAKYAKEEAQAWHEIHTLPNLTVSQMAAFISKLFDDPSQSSELLSEAKKLNDSQAPK

SEQ ID NO: 460 - protein, 58 aa, ARTIFICIAL SEQUENCE
  Engineered IL6 binding polypeptide
VDAKYAKEEREAWLEIHLLPNLTIDQMSAFISKLFDDPSQSSELLSEAKKLNDSQAPK

SEQ ID NO: 461 - protein, 58 aa, ARTIFICIAL SEQUENCE
  Engineered IL6 binding polypeptide
VDAKYAKEEHRAWFEIHLLPNLTTEQMAAFISKLFDDPSQSSELLSEAKKLNDSQAPK

SEQ ID NO: 462 - protein, 58 aa, ARTIFICIAL SEQUENCE
  Engineered IL6 binding polypeptide
VDAKYAKEERRAWYEIHLLPNLTTDQMAAFISKLFDDPSQSSELLSEAKKLNDSQAPK

SEQ ID NO: 463 - protein, 58 aa, ARTIFICIAL SEQUENCE
  Engineered IL6 binding polypeptide
VDAKYAKEEREAWYEIHILPNLTVSQIAAFISKLFDDPSQSSELLSEAKKLNDSQAPK

SEQ ID NO: 464 - protein, 58 aa, ARTIFICIAL SEQUENCE
  Engineered IL6 binding polypeptide
VDAKYAKEERDAWYEIHILPNLTVDQMAAFISKLFDDPSQSSELLSEAKKLNDSQAPK

SEQ ID NO: 465 - protein, 58 aa, ARTIFICIAL SEQUENCE
  Engineered IL6 binding polypeptide
VDAKYAKEERDAWYEIHLLPNLTVSQMAAFISKLFDDPSQSSELLSEAKKLNDSQAPK

SEQ ID NO: 466 - protein, 58 aa, ARTIFICIAL SEQUENCE
  Engineered IL6 binding polypeptide
VDAKYAKEERTAWFEIHSLPNLTAEQMAAFIIKLYDDPSQSSELLSEAKKLNDSQAPK

SEQ ID NO: 467 - protein, 58 aa, ARTIFICIAL SEQUENCE
  Engineered IL6 binding polypeptide
VDAKYAKEEHRAWLEIHTLPNLTVDQMAAFISKLFDDPSQSSELLSEAKKLNDSQAPK

SEQ ID NO: 468 - protein, 58 aa, ARTIFICIAL SEQUENCE
  Engineered IL6 binding polypeptide
VDAKYAKEEHAAWYEIHLLPNLTVSQISAFIQKLFDDPSQSSELLSEAKKLNDSQAPK

SEQ ID NO: 469 - protein, 58 aa, ARTIFICIAL SEQUENCE
  Engineered IL6 binding polypeptide
VDAKYAKEEADAWYEIHALPNLTVDQMAAFISKLFDDPSQSSELLSEAKKLNDSQAPK

SEQ ID NO: 470 - protein, 58 aa, ARTIFICIAL SEQUENCE
  Engineered IL6 binding polypeptide
VDAKYAKEEAEAWWEIHTLPNLTVDQMAAFISKLFDDPSQSSELLSEAKKLNDSQAPK

SEQ ID NO: 471 - protein, 58 aa, ARTIFICIAL SEQUENCE
  Engineered IL6 binding polypeptide
VDAKYAKEEAEAWWEIHKLPNLTVEQMTAFIIKLYDDPSQSSELLSEAKKLNDSQAPK

SEQ ID NO: 472 - protein, 58 aa, ARTIFICIAL SEQUENCE
  Engineered IL6 binding polypeptide
VDAKYAKEEHHAWREIHILPNLTVEQMAAFIIKLFDDPSQSSELLSEAKKLNDSQAPK

SEQ ID NO: 473 - protein, 58 aa, ARTIFICIAL SEQUENCE
  Engineered IL6 binding polypeptide
VDAKYAKEEREAWYEIHLLPNLTIQQMAAFISKLFDDPSQSSELLSEAKKLNDSQAPK

SEQ ID NO: 474 - protein, 58 aa, ARTIFICIAL SEQUENCE
  Engineered IL6 binding polypeptide
VDAKYAKEEHAAWLEIHLLPNLTIDQMAAFISKLFDDPSQSSELLSEAKKLNDSQAPK

SEQ ID NO: 475 - protein, 58 aa, ARTIFICIAL SEQUENCE
  Engineered IL6 binding polypeptide
VDAKYAKEERAAWYEIHLLPNLTIHQMAAFISKLFDDPSQSSELLSEAKKLNDSQAPK

SEQ ID NO: 476 - protein, 58 aa, ARTIFICIAL SEQUENCE
  Engineered IL6 binding polypeptide
VDAKYAKEERTAWYEIHLLPNLTVHQMAAFISKLFDDPSQSSELLSEAKKLNDSQAPK

SEQ ID NO: 477 - protein, 58 aa, ARTIFICIAL SEQUENCE
  Engineered IL6 binding polypeptide
VDAKYAKEERHAWHEIHSLPNLTIDQLTAFISKLFDDPSQSSELLSEAKKLNDSQAPK

SEQ ID NO: 478 - protein, 58 aa, ARTIFICIAL SEQUENCE
  Engineered IL6 binding polypeptide
VDAKYAKEEREAWYEIHSLPNLTVDQVAAFISKLFDDPSQSSELLSEAKKLNDSQAPK

SEQ ID NO: 479 - protein, 58 aa, ARTIFICIAL SEQUENCE
  Engineered IL6 binding polypeptide
VDAKYAKEEHHAWHEIHTLPNLTVHQMAAFISKLFDDPSQSSELLSEAKKLNDSQAPK

SEQ ID NO: 480 - protein, 58 aa, ARTIFICIAL SEQUENCE
  Engineered IL6 binding polypeptide
VDAKYAKEEAHAWHEIHLLPNLTVEQMAAFISKLFDDPSQSSELLSEAKKLNDSQAPK

SEQ ID NO: 481 - protein, 58 aa, ARTIFICIAL SEQUENCE
  Engineered IL6 binding polypeptide
VDAKYAKEEAHAWWEIHKLPNLTVNQVAAFISKLFDDPSQSSELLSEAKKLNDSQAPK

SEQ ID NO: 482 - protein, 58 aa, ARTIFICIAL SEQUENCE
  Engineered IL6 binding polypeptide
VDAKYAKEEARAWYEIHILPNLTVTQMAAFISKLFDDPSQSSELLSEAKKLNDSQAPK

SEQ ID NO: 483 - protein, 58 aa, ARTIFICIAL SEQUENCE
  Engineered IL6 binding polypeptide
VDAKYAKEEARAWWEIHLLPNLTVDQISAFISKLFDDPSQSSELLSEAKKLNDSQAPK

SEQ ID NO: 484 - protein, 58 aa, ARTIFICIAL SEQUENCE
  Engineered IL6 binding polypeptide
VDAKYAKEEHDAWFEIHLLPNLTVEQIAAFISKLFDDPSQSSELLSEAKKLNDSQAPK

SEQ ID NO: 485 - protein, 58 aa, ARTIFICIAL SEQUENCE
  Engineered IL6 binding polypeptide
VDAKYAKEEHTAWYEIHLLPNLTVDQMAAFISKLFDDPSQSSELLSEAKKLNDSQAPK

SEQ ID NO: 486 - protein, 58 aa, ARTIFICIAL SEQUENCE
  Engineered IL6 binding polypeptide
VDAKYAKEEREAWWEIHALPNLTVNQMAAFIIKLFDDPSQSSELLSEAKKLNDSQAPK

SEQ ID NO: 487 - protein, 58 aa, ARTIFICIAL SEQUENCE
  Engineered IL6 binding polypeptide
VDAKYAKEERDAWYEISTLPNLTVEQAAAFISKLFDDPSQSSELLSEAKKLNDSQAPK

SEQ ID NO: 488 - protein, 58 aa, ARTIFICIAL SEQUENCE
  Engineered IL6 binding polypeptide
VDAKYAKEEREAWYEIHLLPNLTITQMAAFISKLFDDPSQSSELLSEAKKLNDSQAPK

SEQ ID NO: 489 - protein, 58 aa, ARTIFICIAL SEQUENCE
  Engineered IL6 binding polypeptide
VDAKYAKEEAKAWFEIHTLPNLTVDQVAAFISKLFDDPSQSSELLSEAKKLNDSQAPK

SEQ ID NO: 490 - protein, 58 aa, ARTIFICIAL SEQUENCE
  Engineered IL6 binding polypeptide
VDAKYAKEERQAWWEIHTLPNLTVEQMSAFISKLYDDPSQSSELLSEAKKLNDSQAPK

SEQ ID NO: 491 - protein, 58 aa, ARTIFICIAL SEQUENCE
  Engineered IL6 binding polypeptide
VDAKYAKEEHEAWHEIHILPNLTIDQMAAFISKLFDDPSQSSELLSEAKKLNDSQAPK

SEQ ID NO: 492 - protein, 58 aa, ARTIFICIAL SEQUENCE
  Engineered IL6 binding polypeptide
VDAKYAKEERDAWFEIHLLPNLTVEQMAAFISKLFDDPSQSSELLSEAKKLNDSQAPK

SEQ ID NO: 493 - protein, 58 aa, ARTIFICIAL SEQUENCE
  Engineered IL6 binding polypeptide
VDAKYAKEEAKAWWEIHSLPNLTVNQMAAFISKLFDDPSQSSELLSEAKKLNDSQAPK

SEQ ID NO: 494 - protein, 58 aa, ARTIFICIAL SEQUENCE
  Engineered IL6 binding polypeptide
VDAKYAKEEARAWWEIHLLPNLTIDQMAAFISKLFDDPSQSSELLSEAKKLNDSQAPK

SEQ ID NO: 495 - protein, 58 aa, ARTIFICIAL SEQUENCE
  Engineered IL6 binding polypeptide
VDAKYAKEEQKAWWEIHSLPNLTVDQITAFISKLFDDPSQSSELLSEAKKLNDSQAPK

SEQ ID NO: 496 - protein, 58 aa, ARTIFICIAL SEQUENCE
  Engineered IL6 binding polypeptide
VDAKYAKEEREAWYEIHLLPNLTVSQIAAFISKLFDDPSQSSELLSEAKKLNDSQAPK

SEQ ID NO: 497 - protein, 58 aa, ARTIFICIAL SEQUENCE
  Engineered IL6 binding polypeptide
VDAKYAKEERRAWHEIQTLPNLTVRQMAAFISKLFDDPSQSSELLSEAKKLNDSQAPK

SEQ ID NO: 498 - protein, 58 aa, ARTIFICIAL SEQUENCE
  Engineered IL6 binding polypeptide
VDAKYAKEERQAWYEIHTLPNLTATQMAAFIQKLFDDPSQSSELLSEAKKLNDSQAPK

SEQ ID NO: 499 - protein, 58 aa, ARTIFICIAL SEQUENCE
  Engineered IL6 binding polypeptide
VDAKYAKEERHAWTEIHLLPNLTVNQMAAFIIKLFDDPSQSSELLSEAKKLNDSQAPK

SEQ ID NO: 500 - protein, 58 aa, ARTIFICIAL SEQUENCE
  Engineered IL6 binding polypeptide
VDAKYAKEEARAWHEIHVLPNLTVNQMTAFISKLFDDPSQSSELLSEAKKLNDSQAPK

SEQ ID NO: 501 - protein, 58 aa, ARTIFICIAL SEQUENCE
  Engineered IL6 binding polypeptide
VDAKYAKEEAEAWYEIHILPNLTVNQIAAFISKLFDDPSQSSELLSEAKKLNDSQAPK

SEQ ID NO: 502 - protein, 58 aa, ARTIFICIAL SEQUENCE
  Engineered IL6 binding polypeptide
VDAKYAKEEAEAWREIHLLPNLTVDQMAAFISKLFDDPSQSSELLSEAKKLNDSQAPK

SEQ ID NO: 503 - protein, 58 aa, ARTIFICIAL SEQUENCE
  Engineered IL6 binding polypeptide
VDAKYAKEERSAWFEIHTLPNLTVDQMAAFISKLFDDPSQSSELLSEAKKLNDSQAPK

SEQ ID NO: 504 - protein, 58 aa, ARTIFICIAL SEQUENCE
  Engineered IL6 binding polypeptide
VDAKYAKEEAQAWYEIHALPNLTVEQMAAFISKLFDDPSQSSELLSEAKKLNDSQAPK

SEQ ID NO: 505 - protein, 58 aa, ARTIFICIAL SEQUENCE
  Engineered IL6 binding polypeptide
VDAKYAKEERTAWWEIHALPNLTVNQVTAFISKLFDDPSQSSELLSEAKKLNDSQAPK

SEQ ID NO: 506 - protein, 58 aa, ARTIFICIAL SEQUENCE
  Engineered IL6 binding polypeptide
VDAKYAKEEAEAWFEIHVLPNLTTDQRVAFITKLFDDPSQSSELLSEAKKLNDSQAPK

SEQ ID NO: 507 - protein, 58 aa, ARTIFICIAL SEQUENCE
  Engineered IL6 binding polypeptide
VDAKYAKEEAEAWYEIHVLPNLTVDQMAAFIQKLFDDPSQSSELLSEAKKLNDSQAPK

SEQ ID NO: 508 - protein, 58 aa, ARTIFICIAL SEQUENCE
  Engineered IL6 binding polypeptide
VDAKYAKEEREAWLEIHLLPNLTVEQMAAFISKLFDDPSQSSELLSEAKKLNDSQAPK

SEQ ID NO: 509 - protein, 58 aa, ARTIFICIAL SEQUENCE
  Engineered IL6 binding polypeptide
VDAKYAKEERAAWWEIHSLPNLTVSQMAAFISKLFDDPSQSSELLSEAKKLNDSQAPK

SEQ ID NO: 510 - protein, 58 aa, ARTIFICIAL SEQUENCE
  Engineered IL6 binding polypeptide
VDAKYAKEEAKAWREIHLLPNLTVNQMAAFISKLFDDPSQSSELLSEAKKLNDSQAPK

SEQ ID NO: 511 - protein, 58 aa, ARTIFICIAL SEQUENCE
  Engineered IL6 binding polypeptide
VDAKYAKEERQAWWEIHALPNLTVTQMAAFISKLFDDPSQSSELLSEAKKLNDSQAPK

SEQ ID NO: 512 - protein, 58 aa, ARTIFICIAL SEQUENCE
  Engineered IL6 binding polypeptide
VDAKYAKEERDAWFEIHTLPNLTVDQMAAFIQKLFDDPSQSSELLSEAKKLNDSQAPK

SEQ ID NO: 513 - protein, 58 aa, ARTIFICIAL SEQUENCE
  Engineered IL6 binding polypeptide
VDAKYAKEERRAWYEIHSLPNLTVNQMAAFISKLFDDPSQSSELLSEAKKLNDSQAPK

SEQ ID NO: 514 - protein, 58 aa, ARTIFICIAL SEQUENCE
  Engineered IL6 binding polypeptide
VDAKYAKEEHQAWHEIHLLPNLTVSQMAAFIQKLFDDPSQSSELLSEAKKLNDSQAPK

SEQ ID NO: 515 - protein, 58 aa, ARTIFICIAL SEQUENCE
  Engineered IL6 binding polypeptide
VDAKYAKEERHAWFEIHKLPNLTTDQIAAFISKLFDDPSQSSELLSEAKKLNDSQAPK

SEQ ID NO: 516 - protein, 58 aa, ARTIFICIAL SEQUENCE
  Engineered IL6 binding polypeptide
VDAKYAKEEAHAWHEIHLLPNLTIDQMAAFIMKLFDDPSQSSELLSEAKKLNDSQAPK

SEQ ID NO: 517 - protein, 58 aa, ARTIFICIAL SEQUENCE
  Engineered IL6 binding polypeptide
VDAKYAKEERAAWYEIHLLPNLTIEQMSAFISKLFDDPSQSSELLSEAKKLNDSQAPK

SEQ ID NO: 518 - protein, 58 aa, ARTIFICIAL SEQUENCE
  Engineered IL6 binding polypeptide
VDAKYAKEEAKAWFEIHALPNLTTTQMAAFISKLFDDPSQSSELLSEAKKLNDSQAPK

SEQ ID NO: 519 - protein, 58 aa, ARTIFICIAL SEQUENCE
  Engineered IL6 binding polypeptide
VDAKYAKEERKAWYEIHILPNLTVDQMAAFISKLFDDPSQSSELLSEAKKLNDSQAPK

SEQ ID NO: 520 - protein, 58 aa, ARTIFICIAL SEQUENCE
  Engineered IL6 binding polypeptide
VDAKYAKEERQAWHEIHILPNLTITQRTAFISKLFDDPSQSSELLSEAKKLNDSQAPK

SEQ ID NO: 521 - protein, 58 aa, ARTIFICIAL SEQUENCE
  Engineered IL6 binding polypeptide
VDAKYAKEERRAWYEIHTLPNLTITQMAAFIQKLFDDPSQSSELLSEAKKLNDSQAPK

SEQ ID NO: 522 - protein, 58 aa, ARTIFICIAL SEQUENCE
  Engineered IL6 binding polypeptide
VDAKYAKEEAEAWLEIHLLPNLTVSQMAAFIWKLFDDPSQSSELLSEAKKLNDSQAPK

SEQ ID NO: 523 - protein, 58 aa, ARTIFICIAL SEQUENCE
  Engineered IL6 binding polypeptide
VDAKYAKEEAHAWWEIHALPNLTTNQMAAFISKLFDDPSQSSELLSEAKKLNDSQAPK

SEQ ID NO: 524 - protein, 58 aa, ARTIFICIAL SEQUENCE
  Engineered IL6 binding polypeptide
VDAKYAKEERHAWTEIHKLPNLTINQMVAFIIKLFDDPSQSSELLSEAKKLNDSQAPK

SEQ ID NO: 525 - protein, 58 aa, ARTIFICIAL SEQUENCE
  Engineered IL6 binding polypeptide
VDAKYAKEERQAWTEIHLLPNLTVDQMAAFISKLFDDPSQSSELLSEAKKLNDSQAPK

SEQ ID NO: 526 - protein, 58 aa, ARTIFICIAL SEQUENCE
  Engineered IL6 binding polypeptide
VDAKYAKEEAHAWHEIHILPNLTVRQMAAFISKLFDDPSQSSELLSEAKKLNDSQAPK

SEQ ID NO: 527 - protein, 58 aa, ARTIFICIAL SEQUENCE
  Engineered IL6 binding polypeptide
VDAKYAKEERQAWHEIHTLPNLTVNQMAAFISKLFDDPSQSSELLSEAKKLNDSQAPK

SEQ ID NO: 528 - protein, 58 aa, ARTIFICIAL SEQUENCE
  Engineered IL6 binding polypeptide
VDAKYAKEERHAWWEIHKLPNLTVNQMAAFISKLFDDPSQSSELLSEAKKLNDSQAPK

SEQ ID NO: 529 - protein, 58 aa, ARTIFICIAL SEQUENCE
  Engineered IL6 binding polypeptide
VDAKYAKEEAKAWFEIHKLPNLTANQMAAFIIKLYDDPSQSSELLSEAKKLNDSQAPK

SEQ ID NO: 530 - protein, 58 aa, ARTIFICIAL SEQUENCE
  Engineered IL6 binding polypeptide
VDAKYAKEEREAWYEIHILPNLTVQQRVAFISKLFDDPSQSSELLSEAKKLNDSQAPK

SEQ ID NO: 531 - protein, 58 aa, ARTIFICIAL SEQUENCE
  Engineered IL6 binding polypeptide
VDAKYAKEEQEAWHEIHILPNLTVTQMTAFISKLFDDPSQSSELLSEAKKLNDSQAPK

SEQ ID NO: 532 - protein, 58 aa, ARTIFICIAL SEQUENCE
  Engineered IL6 binding polypeptide
VDAKYAKEERQAWFEIHVLPNLTIEQMAAFISKLFDDPSQSSELLSEAKKLNDSQAPK

SEQ ID NO: 533 - protein, 58 aa, ARTIFICIAL SEQUENCE
  Engineered IL6 binding polypeptide
VDAKYAKEERQAWYEIHKLPNLTVSQMTAFISKLFDDPSQSSELLSEAKKLNDSQAPK

SEQ ID NO: 534 - protein, 58 aa, ARTIFICIAL SEQUENCE
  Engineered IL6 binding polypeptide
VDAKYAKEEREAWWEIHLLPNLTIDQMAAFIQKLFDDPSQSSELLSEAKKLNDSQAPK

SEQ ID NO: 535 - protein, 58 aa, ARTIFICIAL SEQUENCE
  Engineered IL6 binding polypeptide
VDAKYAKEERDAWYEIHTLPNLTVHQMAAFISKLFDDPSQSSELLSEAKKLNDSQAPK

SEQ ID NO: 536 - protein, 58 aa, ARTIFICIAL SEQUENCE
  Engineered IL6 binding polypeptide
VDAKYAKEEQAAWFEIHALPNLTVSQMAAFISKLFDDPSQSSELLSEAKKLNDSQAPK

SEQ ID NO: 537 - protein, 58 aa, ARTIFICIAL SEQUENCE
  Engineered IL6 binding polypeptide
VDAKYAKEEAHAWYEIHILPNLTVRQIAAFIQKLFDDPSQSSELLSEAKKLNDSQAPK

SEQ ID NO: 538 - protein, 58 aa, ARTIFICIAL SEQUENCE
  Engineered IL6 binding polypeptide
VDAKYAKEEAKAWWEIHSLPNLTAEQVSAFIQKLFDDPSQSSELLSEAKKLNDSQAPK

SEQ ID NO: 539 - protein, 58 aa, ARTIFICIAL SEQUENCE
  Engineered IL6 binding polypeptide
VDAKYAKEEQKAWHEIHILPNLTTHQRVAFISKLFDDPSQSSELLSEAKKLNDSQAPK

SEQ ID NO: 540 - protein, 58 aa, ARTIFICIAL SEQUENCE
  Engineered IL6 binding polypeptide
VDAKYAKEERQAWYEIHALPNLTVTQMAAFISKLFDDPSQSSELLSEAKKLNDSQAPK

SEQ ID NO: 541 - protein, 58 aa, ARTIFICIAL SEQUENCE
  Engineered IL6 binding polypeptide
VDAKYAKEERDAWYEIHILPNLTVSQMSAFIQKLFDDPSQSSELLSEAKKLNDSQAPK

SEQ ID NO: 542 - protein, 58 aa, ARTIFICIAL SEQUENCE
  Engineered IL6 binding polypeptide
VDAKYAKEEHDAWYEIHLLPNLTVQQMAAFISKLFDDPSQSSELLSEAKKLNDSQAPK

SEQ ID NO: 543 - protein, 58 aa, ARTIFICIAL SEQUENCE
  Engineered IL6 binding polypeptide
VDAKYAKEEAHAWREIHLLPNLTVHQRTAFISKLFDDPSQSSELLSEAKKLNDSQAPK

SEQ ID NO: 544 - protein, 58 aa, ARTIFICIAL SEQUENCE
  Engineered IL6 binding polypeptide
VDAKYAKEERHAWREIHLLPNLTHTQMAAFISKLFDDPSQSSELLSEAKKLNDSQAPK

SEQ ID NO: 545 - protein, 58 aa, ARTIFICIAL SEQUENCE
  Engineered IL6 binding polypeptide
VDAKYAKEERHAWYEIHVLPNLTIQQMAAFIQKLFDDPSQSSELLSEAKKLNDSQAPK

SEQ ID NO: 546 - protein, 58 aa, ARTIFICIAL SEQUENCE
  Engineered IL6 binding polypeptide
VDAKYAKEERKAWYEIHILPNLTTNQMAAFISKLFDDPSQSSELLSEAKKLNDSQAPK

SEQ ID NO: 547 - protein, 58 aa, ARTIFICIAL SEQUENCE
  Engineered IL6 binding polypeptide
VDAKYAKEERDAWREIHLLPNLTVRQLSAFISKLFDDPSQSSELLSEAKKLNDSQAPK

SEQ ID NO: 548 - protein, 58 aa, ARTIFICIAL SEQUENCE
  Engineered IL6 binding polypeptide
VDAKYAKEERQAWYEIHLLPNLTTQQMAAFIQKLFDDPSQSSELLSEAKKLNDSQAPK

SEQ ID NO: 549 - protein, 58 aa, ARTIFICIAL SEQUENCE
  Engineered IL6 binding polypeptide
VDAKYAKEERKAWREIHTLPNLTVQQMAAFISKLFDDPSQSSELLSEAKKLNDSQAPK

SEQ ID NO: 550 - protein, 58 aa, ARTIFICIAL SEQUENCE
  Engineered IL6 binding polypeptide
VDAKYAKEERHAWLEIHKLPNLTATQMAAFISKLFDDPSQSSELLSEAKKLNDSQAPK

SEQ ID NO: 551 - protein, 58 aa, ARTIFICIAL SEQUENCE
  Engineered IL6 binding polypeptide
VDAKYAKEEREAWYEIHVLPNLTVEQMVAFIIKLYDDPSQSSELLSEAKKLNDSQAPK

SEQ ID NO: 552 - protein, 58 aa, ARTIFICIAL SEQUENCE
  Engineered IL6 binding polypeptide
VDAKYAKEERQAWFEIHTLPNLTVDQMVAFISKLFDDPSQSSELLSEAKKLNDSQAPK

SEQ ID NO: 553 - protein, 58 aa, ARTIFICIAL SEQUENCE
  Engineered IL6 binding polypeptide
VDAKYAKEEARAWYEIHSLPNLTVDQMSAFIIKLYDDPSQSSELLSEAKKLNDSQAPK

SEQ ID NO: 554 - protein, 58 aa, ARTIFICIAL SEQUENCE
  Engineered IL6 binding polypeptide
VDAKYAKEEAHAWWEIHLLPNLTVHQIAAFISKLFDDPSQSSELLSEAKKLNDSQAPK

SEQ ID NO: 555 - protein, 58 aa, ARTIFICIAL SEQUENCE
  Engineered IL6 binding polypeptide
VDAKYAKEEAQAWHEIHILPNLTIQQIAAFISKLFDDPSQSSELLSEAKKLNDSQAPK

SEQ ID NO: 556 - protein, 58 aa, ARTIFICIAL SEQUENCE
  Engineered IL6 binding polypeptide
VDAKYAKEEQDAWWEIHKLPNLTVNQMAAFISKLYDDPSQSSELLSEAKKLNDSQAPK

SEQ ID NO: 557 - protein, 58 aa, ARTIFICIAL SEQUENCE
  Engineered IL6 binding polypeptide
VDAKYAKEERAAWHEIHLLPNLTISQMAAFISKLFDDPSQSSELLSEAKKLNDSQAPK

SEQ ID NO: 558 - protein, 58 aa, ARTIFICIAL SEQUENCE
  Engineered IL6 binding polypeptide
VDAKYAKEERQAWFEIHVLPNLTIHQIAAFISKLFDDPSQSSELLSEAKKLNDSQAPK

SEQ ID NO: 559 - protein, 58 aa, ARTIFICIAL SEQUENCE
  Engineered IL6 binding polypeptide
VDAKYAKEEREAWWEIHALPNLTANQMAAFISKLFDDPSQSSELLSEAKKLNDSQAPK

SEQ ID NO: 560 - protein, 58 aa, ARTIFICIAL SEQUENCE
  Engineered IL6 binding polypeptide
VDAKYAKEEATAWHEIHLLPNLTITQMAAFISKLFDDPSQSSELLSEAKKLNDSQAPK

SEQ ID NO: 561 - protein, 58 aa, ARTIFICIAL SEQUENCE
  Engineered IL6 binding polypeptide
VDAKYAKEERKAWYEIHLLPNLTISQMTAFISKLFDDPSQSSELLSEAKKLNDSQAPK

SEQ ID NO: 562 - protein, 58 aa, ARTIFICIAL SEQUENCE
  Engineered IL6 binding polypeptide
VDAKYAKEEAKAWFEIHALPNLTIQQMAAFISKLFDDPSQSSELLSEAKKLNDSQAPK

SEQ ID NO: 563 - protein, 58 aa, ARTIFICIAL SEQUENCE
  Engineered IL6 binding polypeptide
VDAKYAKEEARAWHEIHILPNLTTQQMAAFISKLFDDPSQSSELLSEAKKLNDSQAPK

SEQ ID NO: 564 - protein, 58 aa, ARTIFICIAL SEQUENCE
  Engineered IL6 binding polypeptide
VDAKYAKEEAQAWYEIHLLPNLTVSQIAAFIVKLYDDPSQSSELLSEAKKLNDSQAPK

SEQ ID NO: 565 - protein, 58 aa, ARTIFICIAL SEQUENCE
  Engineered IL6 binding polypeptide
VDAKYAKEERHAWFEIHKLPNLTVDQVSAFIIKLYDDPSQSSELLSEAKKLNDSQAPK

SEQ ID NO: 566 - protein, 58 aa, ARTIFICIAL SEQUENCE
  Engineered IL6 binding polypeptide
VDAKYAKEERQAWYEIHVLPNLTVSQMTAFISKLFDDPSQSSELLSEAKKLNDSQAPK

SEQ ID NO: 567 - protein, 58 aa, ARTIFICIAL SEQUENCE
  Engineered IL6 binding polypeptide
VDAKYAKEEADAWHEIHLLPNLTIDQMAAFISKLFDDPSQSSELLSEAKKLNDSQAPK

SEQ ID NO: 568 - protein, 58 aa, ARTIFICIAL SEQUENCE
  Engineered IL6 binding polypeptide
VDAKYAKEEASAWREIHILPNLTVNQMAAFISKLFDDPSQSSELLSEAKKLNDSQAPK

SEQ ID NO: 569 - protein, 58 aa, ARTIFICIAL SEQUENCE
  Engineered IL6 binding polypeptide
VDAKYAKEEAQAWYEIHILPNLTVDQMAAFISKLFDDPSQSSELLSEAKKLNDSQAPK

SEQ ID NO: 570 - protein, 58 aa, ARTIFICIAL SEQUENCE
  Engineered IL6 binding polypeptide
VDAKYAKEERSAWYEIHILPNLTVHQMTAFISKLFDDPSQSSELLSEAKKLNDSQAPK

SEQ ID NO: 571 - protein, 58 aa, ARTIFICIAL SEQUENCE
  Engineered IL6 binding polypeptide
VDAKYAKEEATAWREIHLLPNLTVEQMAAFISKLFDDPSQSSELLSEAKKLNDSQAPK

SEQ ID NO: 572 - protein, 58 aa, ARTIFICIAL SEQUENCE
  Engineered IL6 binding polypeptide
VDAKYAKEERTAWYEIHILPNLTVEQMTAFIQKLFDDPSQSSELLSEAKKLNDSQAPK

SEQ ID NO: 573 - protein, 58 aa, ARTIFICIAL SEQUENCE
  Engineered IL6 binding polypeptide
VDAKYAKEEAHAWHEIHILPNLTVDQVVAFISKLFDDPSQSSELLSEAKKLNDSQAPK

SEQ ID NO: 574 - protein, 58 aa, ARTIFICIAL SEQUENCE
  Engineered IL6 binding polypeptide
VDAKYAKEERRAWYEIHLLPNLTVEQMAAFISKLFDDPSQSSELLSEAKKLNDSQAPK

SEQ ID NO: 575 - protein, 58 aa, ARTIFICIAL SEQUENCE
  Engineered IL6 binding polypeptide
VDAKYAKEERKAWYEIHLLPNLTVSQMTAFISKLFDDPSQSSELLSEAKKLNDSQAPK

SEQ ID NO: 576 - protein, 58 aa, ARTIFICIAL SEQUENCE
  Engineered IL6 binding polypeptide
VDAKYAKEERRAWFEIHSLPNLTVRQIAAFIIKLFDDPSQSSELLSEAKKLNDSQAPK

SEQ ID NO: 577 - protein, 58 aa, ARTIFICIAL SEQUENCE
  Engineered IL6 binding polypeptide
VDAKYAKEERQAWTEIHVLPNLTVNQMAAFISKLFDDPSQSSELLSEAKKLNDSQAPK

SEQ ID NO: 578 - protein, 58 aa, ARTIFICIAL SEQUENCE
  Engineered IL6 binding polypeptide
VDAKYAKEEAHAWYEIHILPNLTIQQMAAFISKLFDDPSQSSELLSEAKKLNDSQAPK

SEQ ID NO: 579 - protein, 58 aa, ARTIFICIAL SEQUENCE
  Engineered IL6 binding polypeptide
VDAKYAKEERSAWYEIHLLPNLTVDQMTAFIQKLFDDPSQSSELLSEAKKLNDSQAPK

SEQ ID NO: 580 - protein, 58 aa, ARTIFICIAL SEQUENCE
  Engineered IL6 binding polypeptide
VDAKYAKEERRAWWEIHTLPNLTVDQMVAFISKLFDDPSQSSELLSEAKKLNDSQAPK

SEQ ID NO: 581 - protein, 58 aa, ARTIFICIAL SEQUENCE
  Engineered IL6 binding polypeptide
VDAKYAKEERAAWFEIHMLPNLTVEQMAAFISKLFDDPSQSSELLSEAKKLNDSQAPK

SEQ ID NO: 582 - protein, 58 aa, ARTIFICIAL SEQUENCE
  Engineered IL6 binding polypeptide
VDAKYAKEERTAWYEIHALPNLTVDQMVAFISKLFDDPSQSSELLSEAKKLNDSQAPK

SEQ ID NO: 583 - protein, 58 aa, ARTIFICIAL SEQUENCE
  Engineered IL6 binding polypeptide
VDAKYAKEERQAWWEIHALPNLTVSQMAAFISKLFDDPSQSSELLSEAKKLNDSQAPK

SEQ ID NO: 584 - protein, 58 aa, ARTIFICIAL SEQUENCE
  Engineered IL6 binding polypeptide
VDAKYAKEERAAWYEIHLLPNLTVEQMAAFISKLFDDPSQSSELLSEAKKLNDSQAPK

SEQ ID NO: 585 - protein, 58 aa, ARTIFICIAL SEQUENCE
  Engineered IL6 binding polypeptide
VDAKYAKEEQQAWWEIHALPNLTIDQMTAFISKLFDDPSQSSELLSEAKKLNDSQAPK

SEQ ID NO: 586 - protein, 58 aa, ARTIFICIAL SEQUENCE
  Engineered IL6 binding polypeptide
VDAKYAKEERRAWFEIHSLPNLTVRQMAAFISKLFDDPSQSSELLSEAKKLNDSQAPK

SEQ ID NO: 587 - protein, 58 aa, ARTIFICIAL SEQUENCE
  Engineered IL6 binding polypeptide
VDAKYAKEERHAWWEIHKLPNLTVDQMAAFISKLFDDPSQSSELLSEAKKLNDSQAPK

SEQ ID NO: 588 - protein, 58 aa, ARTIFICIAL SEQUENCE
  Engineered IL6 binding polypeptide
VDAKYAKEERKAWWEIHLLPNLTVTQIAAFISKLFDDPSQSSELLSEAKKLNDSQAPK

SEQ ID NO: 589 - protein, 58 aa, ARTIFICIAL SEQUENCE
  Engineered IL6 binding polypeptide
VDAKYAKEERRAWFEIHSLPNLTVHQMAAFISKLFDDPSQSSELLSEAKKLNDSQAPK

SEQ ID NO: 590 - protein, 58 aa, ARTIFICIAL SEQUENCE
  Engineered IL6 binding polypeptide
VDAKYAKEEAAAWWEIHMLPNLTVSQMAAFISKLFDDPSQSSELLSEAKKLNDSQAPK

SEQ ID NO: 591 - protein, 58 aa, ARTIFICIAL SEQUENCE
  Engineered IL6 binding polypeptide
VDAKYAKEEAKAWHEIHLLPNLTVHQMAAFIIKLFDDPSQSSELLSEAKKLNDSQAPK

SEQ ID NO: 592 - protein, 58 aa, ARTIFICIAL SEQUENCE
  Engineered IL6 binding polypeptide
VDAKYAKEERKAWTEIHLLPNLTVEQMAAFISKLFDDPSQSSELLSEAKKLNDSQAPK

SEQ ID NO: 593 - protein, 58 aa, ARTIFICIAL SEQUENCE
  Engineered IL6 binding polypeptide
VDAKYAKEEREAWFEIHVLPNLTIRQMAAFISKLFDDPSQSSELLSEAKKLNDSQAPK

SEQ ID NO: 594 - protein, 58 aa, ARTIFICIAL SEQUENCE
  Engineered IL6 binding polypeptide
VDAKYAKEEREAWYEIHALPNLTVQQMSAFISKLFDDPSQSSELLSEAKKLNDSQAPK

SEQ ID NO: 595 - protein, 58 aa, ARTIFICIAL SEQUENCE
  Engineered IL6 binding polypeptide
VDAKYAKEERQAWFEIHTLPNLTANQMAAFIIKLYDDPSQSSELLSEAKKLNDSQAPK

SEQ ID NO: 596 - protein, 58 aa, ARTIFICIAL SEQUENCE
  Engineered IL6 binding polypeptide
VDAKYAKEERHAWYEIHTLPNLTVQQMAAFISKLFDDPSQSSELLSEAKKLNDSQAPK

SEQ ID NO: 597 - protein, 58 aa, ARTIFICIAL SEQUENCE
  Engineered IL6 binding polypeptide
VDAKYAKEERRAWYEIHLLPNLTVNQMVAFISKLFDDPSQSSELLSEAKKLNDSQAPK

SEQ ID NO: 598 - protein, 58 aa, ARTIFICIAL SEQUENCE
  Engineered IL6 binding polypeptide
VDAKYAKEERHAWYEIHLLPNLTVEQMAAFISKLFDDPSQSSELLSEAKKLNDSQAPK

SEQ ID NO: 599 - protein, 58 aa, ARTIFICIAL SEQUENCE
  Engineered IL6 binding polypeptide
VDAKYAKEERKAWYEIHLLPNLTVHQMAAFISKLFDDPSQSSELLSEAKKLNDSQAPK

SEQ ID NO: 600 - protein, 58 aa, ARTIFICIAL SEQUENCE
  Engineered IL6 binding polypeptide
VDAKYAKEERSAWWEIHTLPNLTVDQMVAFISKLFDDPSQSSELLSEAKKLNDSQAPK

SEQ ID NO: 601 - protein, 58 aa, ARTIFICIAL SEQUENCE
  Engineered IL6 binding polypeptide
VDAKYAKEEARAWFEIHTLPNLTVDQMAAFISKLFDDPSQSSELLSEAKKLNDSQAPK

SEQ ID NO: 602 - protein, 58 aa, ARTIFICIAL SEQUENCE
  Engineered IL6 binding polypeptide
VDAKYAKEERRAWYEIHSLPNLTVTQMVAFISKLFDDPSQSSELLSEAKKLNDSQAPK

SEQ ID NO: 603 - protein, 58 aa, ARTIFICIAL SEQUENCE
  Engineered IL6 binding polypeptide
VDAKYAKEEARAWHEIHVLPNLTVEQMTAFIIKLFDDPSQSSELLSEAKKLNDSQAPK

SEQ ID NO: 604 - protein, 58 aa, ARTIFICIAL SEQUENCE
  Engineered IL6 binding polypeptide
VDAKYAKEERDAWYEIHLLPNLTIDQMAAFIQKLFDDPSQSSELLSEAKKLNDSQAPK

SEQ ID NO: 605 - protein, 58 aa, ARTIFICIAL SEQUENCE
  Engineered IL6 binding polypeptide
VDAKYAKEEREAWWEIHLLPNLTIRQMAAFISKLFDDPSQSSELLSEAKKLNDSQAPK

SEQ ID NO: 606 - protein, 58 aa, ARTIFICIAL SEQUENCE
  Engineered IL6 binding polypeptide
VDAKYAKEEQQAWYEIHLLPNLTVEQMAAFISKLFDDPSQSSELLSEAKKLNDSQAPK

SEQ ID NO: 607 - protein, 58 aa, ARTIFICIAL SEQUENCE
  Engineered IL6 binding polypeptide
VDAKYAKEERDAWWEIHALPNLTVNQMAAFISKLFDDPSQSSELLSEAKKLNDSQAPK

SEQ ID NO: 608 - protein, 58 aa, ARTIFICIAL SEQUENCE
  Engineered IL6 binding polypeptide
VDAKYAKEEARAWYEIHILPNLTVTQMAAFIQKLFDDPSQSSELLSEAKKLNDSQAPK

SEQ ID NO: 609 - protein, 58 aa, ARTIFICIAL SEQUENCE
  Engineered IL6 binding polypeptide
VDAKYAKEERVAWYEIHMLPNLTVSQMAAFISKLFDDPSQSSELLSEAKKLNDSQAPK

SEQ ID NO: 610 - protein, 58 aa, ARTIFICIAL SEQUENCE
  Engineered IL6 binding polypeptide
VDAKYAKEERTAWWEIHALPNLTVQQRSAFISKLFDDPSQSSELLSEAKKLNDSQAPK

SEQ ID NO: 611 - protein, 58 aa, ARTIFICIAL SEQUENCE
  Engineered IL6 binding polypeptide
VDAKYAKEEAKAWYEIHLLPNLTVRQMAAFISKLFDDPSQSSELLSEAKKLNDSQAPK

SEQ ID NO: 612 - protein, 58 aa, ARTIFICIAL SEQUENCE
  Engineered IL6 binding polypeptide
VDAKYAKEERKAWYEIHLLPNLTVRQMAAFIWKLLDDPSQSSELLSEAKKLNDSQAPK

SEQ ID NO: 613 - protein, 58 aa, ARTIFICIAL SEQUENCE
  Engineered IL6 binding polypeptide
VDAKYAKEERQAWYEIHTLPNLTIDQMSAFISKLFDDPSQSSELLSEAKKLNDSQAPK

SEQ ID NO: 614 - protein, 58 aa, ARTIFICIAL SEQUENCE
  Engineered IL6 binding polypeptide
VDAKYAKEERKAWWEIHKLPNLTVTQMAAFISKLFDDPSQSSELLSEAKKLNDSQAPK

SEQ ID NO: 615 - protein, 58 aa, ARTIFICIAL SEQUENCE
  Engineered IL6 binding polypeptide
VDAKYAKEERKAWYEIHALPNLTVEQMAAFIQKLFDDPSQSSELLSEAKKLNDSQAPK

SEQ ID NO: 616 - protein, 58 aa, ARTIFICIAL SEQUENCE
  Engineered IL6 binding polypeptide
VDAKYAKEEAHAWREIHLLPNLTVQQIAAFISKLFDDPSQSSELLSEAKKLNDSQAPK

SEQ ID NO: 617 - protein, 58 aa, ARTIFICIAL SEQUENCE
  Engineered IL6 binding polypeptide
VDAKYAKEERHAWHEIHILPNLTVQQMAAFISKLFDDPSQSSELLSEAKKLNDSQAPK

SEQ ID NO: 618 - protein, 58 aa, ARTIFICIAL SEQUENCE
  Engineered IL6 binding polypeptide
VDAKYAKEERDAWFEIHALPNLTANQMAAFISKLFDDPSQSSELLSEAKKLNDSQAPK

SEQ ID NO: 619 - protein, 58 aa, ARTIFICIAL SEQUENCE
  Engineered IL6 binding polypeptide
VDAKYAKEEAKAWYEIHLLPNLTVNQMAAFISKLFDDPSQSSELLSEAKKLNDSQAPK

SEQ ID NO: 620 - protein, 58 aa, ARTIFICIAL SEQUENCE
  Engineered IL6 binding polypeptide
VDAKYAKEERDAWFEIHSLPNLTVSQMAAFIIKLFDDPSQSSELLSEAKKLNDSQAPK

SEQ ID NO: 621 - protein, 58 aa, ARTIFICIAL SEQUENCE
  Engineered IL6 binding polypeptide
VDAKYAKEERKAWWEIHVLPNLTVDQMAAFISKLFDDPSQSSELLSEAKKLNDSQAPK

SEQ ID NO: 622 - protein, 58 aa, ARTIFICIAL SEQUENCE
  Engineered IL6 binding polypeptide
VDAKYAKEEAHAWYEIHTLPNLTVRQMAAFISKLFDDPSQSSELLSEAKKLNDSQAPK

SEQ ID NO: 623 - protein, 58 aa, ARTIFICIAL SEQUENCE
  Engineered IL6 binding polypeptide
VDAKYAKEEARAWREIHTLPNLTVNQMAAFISKLFDDPSQSSELLSEAKKLNDSQAPK

SEQ ID NO: 624 - protein, 58 aa, ARTIFICIAL SEQUENCE
  Engineered IL6 binding polypeptide
VDAKYAKEERRAWTEIHLLPNLTVEQMAAFISKLFDDPSQSSELLSEAKKLNDSQAPK

SEQ ID NO: 625 - protein, 58 aa, ARTIFICIAL SEQUENCE
  Engineered IL6 binding polypeptide
VDAKYAKEEAHAWHEIHTLPNLTIDQMVAFISKLFDDPSQSSELLSEAKKLNDSQAPK

SEQ ID NO: 626 - protein, 58 aa, ARTIFICIAL SEQUENCE
  Engineered IL6 binding polypeptide
VDAKYAKEERQAWYEIHLLPNLTVHQMAAFISKLFDDPSQSSELLSEAKKLNDSQAPK

SEQ ID NO: 627 - protein, 58 aa, ARTIFICIAL SEQUENCE
  Engineered IL6 binding polypeptide
VDAKYAKEERRAWWEIHLLPNLTVRQMAAFISKLFDDPSQSSELLSEAKKLNDSQAPK

SEQ ID NO: 628 - protein, 58 aa, ARTIFICIAL SEQUENCE
  Engineered IL6 binding polypeptide
VDAKYAKEEAHAWTEIHKLPNLTVDQMTAFIIKLYDDPSQSSELLSEAKKLNDSQAPK

SEQ ID NO: 629 - protein, 58 aa, ARTIFICIAL SEQUENCE
  Engineered IL6 binding polypeptide
VDAKYAKEEARAWREIHLLPNLTVTQMAAFISKLFDDPSQSSELLSEAKKLNDSQAPK

SEQ ID NO: 630 - protein, 58 aa, ARTIFICIAL SEQUENCE
  Engineered IL6 binding polypeptide
VDAKYAKEERQAWWEIHSLPNLTIEQMVAFISKLFDDPSQSSELLSEAKKLNDSQAPK

SEQ ID NO: 631 - protein, 58 aa, ARTIFICIAL SEQUENCE
  Engineered IL6 binding polypeptide
VDAKYAKEERDAWYEIHLLPNLTIQQMAAFIQKLFDDPSQSSELLSEAKKLNDSQAPK

SEQ ID NO: 632 - protein, 58 aa, ARTIFICIAL SEQUENCE
  Engineered IL6 binding polypeptide
VDAKYAKEERTAWWEIHKLPNLTVTQMAAFISKLFDDPSQSSELLSEAKKLNDSQAPK

SEQ ID NO: 633 - protein, 58 aa, ARTIFICIAL SEQUENCE
  Engineered IL6 binding polypeptide
VDAKYAKEERDAWYEIHILPNLTIEQMAAFISKLFDDPSQSSELLSEAKKLNDSQAPK

SEQ ID NO: 634 - protein, 58 aa, ARTIFICIAL SEQUENCE
  Engineered IL6 binding polypeptide
VDAKYAKEEREAWWEIHSLPNLTAHQMAAFIIKLFDDPSQSSELLSEAKKLNDSQAPK

SEQ ID NO: 635 - protein, 58 aa, ARTIFICIAL SEQUENCE
  Engineered IL6 binding polypeptide
VDAKYAKEERKAWYEIHSLPNLTVSQMSAFISKLFDDPSQSSELLSEAKKLNDSQAPK

SEQ ID NO: 636 - protein, 58 aa, ARTIFICIAL SEQUENCE
  Engineered IL6 binding polypeptide
VDAKYAKEERHAWFEIHALPNLTVSQMVAFISKLFDDPSQSSELLSEAKKLNDSQAPK

SEQ ID NO: 637 - protein, 58 aa, ARTIFICIAL SEQUENCE
  Engineered IL6 binding polypeptide
VDAKYAKEERHAWREIHLLPNLTTEQMSAFIQKLFDDPSQSSELLSEAKKLNDSQAPK

SEQ ID NO: 638 - protein, 58 aa, ARTIFICIAL SEQUENCE
  Engineered IL6 binding polypeptide
VDAKYAKEEHRAWTEIHTLPNLTVDQMAAFIIKLFDDPSQSSELLSEAKKLNDSQAPK

SEQ ID NO: 639 - protein, 58 aa, ARTIFICIAL SEQUENCE
  Engineered IL6 binding polypeptide
VDAKYAKEERDAWYEIHLLPNLTTQQRAAFIVKLFDDPSQSSELLSEAKKLNDSQAPK

SEQ ID NO: 640 - protein, 58 aa, ARTIFICIAL SEQUENCE
  Engineered IL6 binding polypeptide
VDAKYAKEEAQAWWEIHALPNLTVSQMVAFIMKLFDDPSQSSELLSEAKKLNDSQAPK

SEQ ID NO: 641 - protein, 58 aa, ARTIFICIAL SEQUENCE
  Engineered IL6 binding polypeptide
VDAKYAKEEREAWWEIHALPNLTVNQVVAFISKLFDDPSQSSELLSEAKKLNDSQAPK

SEQ ID NO: 642 - protein, 58 aa, ARTIFICIAL SEQUENCE
  Engineered IL6 binding polypeptide
VDAKYAKEERQAWYEIHVLPNLTVNQMAAFISKLFDDPSQSSELLSEAKKLNDSQAPK

SEQ ID NO: 643 - protein, 58 aa, ARTIFICIAL SEQUENCE
  Engineered IL6 binding polypeptide
VDAKYAKEERSAWYEIHLLPNLTVHQMTAFISKLFDDPSQSSELLSEAKKLNDSQAPK

SEQ ID NO: 644 - protein, 58 aa, ARTIFICIAL SEQUENCE
  Engineered IL6 binding polypeptide
VDAKYAKEEAKAWYEIHILPNLTVHQIAAFIQKLFDDPSQSSELLSEAKKLNDSQAPK

SEQ ID NO: 645 - protein, 58 aa, ARTIFICIAL SEQUENCE
  Engineered IL6 binding polypeptide
VDAKYAKEEQQAWLEIHTLPNLTVSQMAAFISKLFDDPSQSSELLSEAKKLNDSQAPK

SEQ ID NO: 646 - protein, 58 aa, ARTIFICIAL SEQUENCE
  Engineered IL6 binding polypeptide
VDAKYAKEEAHAWREIHLLPNLTVTQMAAFISKLFDDPSQSSELLSEAKKLNDSQAPK

SEQ ID NO: 647 - protein, 58 aa, ARTIFICIAL SEQUENCE
  Engineered IL6 binding polypeptide
VDAKYAKEERAAWFEIHLLPNLTIHQMAAFISKLFDDPSQSSELLSEAKKLNDSQAPK

SEQ ID NO: 648 - protein, 58 aa, ARTIFICIAL SEQUENCE
  Engineered IL6 binding polypeptide
VDAKYAKEEQQAWYEIHILPNLTVSQMAAFISKLFDDPSQSSELLSEAKKLNDSQAPK

SEQ ID NO: 649 - protein, 58 aa, ARTIFICIAL SEQUENCE
  Engineered IL6 binding polypeptide
VDAKYAKEERDAWYEIHTLPNLTINQMAAFISKLFDDPSQSSELLSEAKKLNDSQAPK

SEQ ID NO: 650 - protein, 58 aa, ARTIFICIAL SEQUENCE
  Engineered IL6 binding polypeptide
VDAKYAKEEAHAWYEIHILPNLTVNQITAFISKLFDDPSQSSELLSEAKKLNDSQAPK

SEQ ID NO: 651 - protein, 58 aa, ARTIFICIAL SEQUENCE
  Engineered IL6 binding polypeptide
VDAKYAKEERRAWWEIHALPNLTVSQMVAFISKLFDDPSQSSELLSEAKKLNDSQAPK

SEQ ID NO: 652 - protein, 58 aa, ARTIFICIAL SEQUENCE
  Engineered IL6 binding polypeptide
VDAKYAKEEAQAWYEIHTLPNLTVHQMAAFISKLFDDPSQSSELLSEAKKLNDSQAPK

SEQ ID NO: 653 - protein, 58 aa, ARTIFICIAL SEQUENCE
  Engineered IL6 binding polypeptide
VDAKYAKEERAAWFEIHKLPNLTVEQMTAFIHKLYDDPSQSSELLSEAKKLNDSQAPK

SEQ ID NO: 654 - protein, 58 aa, ARTIFICIAL SEQUENCE
  Engineered IL6 binding polypeptide
VDAKYAKEEAHAWREIHLLPNLTITQMAAFIQKLFDDPSQSSELLSEAKKLNDSQAPK

SEQ ID NO: 655 - protein, 58 aa, ARTIFICIAL SEQUENCE
  Engineered IL6 binding polypeptide
VDAKYAKEEARAWHEIHVLPNLTVTQVVAFISKLFDDPSQSSELLSEAKKLNDSQAPK

SEQ ID NO: 656 - protein, 58 aa, ARTIFICIAL SEQUENCE
  Engineered IL6 binding polypeptide
VDAKYAKEEAKAWHEIHVLPNLTVSQIAAFISKLFDDPSQSSELLSEAKKLNDSQAPK

SEQ ID NO: 657 - protein, 58 aa, ARTIFICIAL SEQUENCE
  Engineered IL6 binding polypeptide
VDAKYAKEEHRAWYEIHLLPNLTINQMAAFISKLFDDPSQSSELLSEAKKLNDSQAPK

SEQ ID NO: 658 - protein, 58 aa, ARTIFICIAL SEQUENCE
  Engineered IL6 binding polypeptide
VDAKYAKEEAHAWTEIHKLPNLTTQQMAAFIQKLFDDPSQSSELLSEAKKLNDSQAPK

SEQ ID NO: 659 - protein, 58 aa, ARTIFICIAL SEQUENCE
  Engineered IL6 binding polypeptide
VDAKYAKEERTAWYEIHLLPNLTVRQMVAFISKLFDDPSQSSELLSEAKKLNDSQAPK

SEQ ID NO: 660 - protein, 58 aa, ARTIFICIAL SEQUENCE
  Engineered IL6 binding polypeptide
VDAKYAKEERKAWYEIHLLPNLTIQQIAAFISKLFDDPSQSSELLSEAKKLNDSQAPK

SEQ ID NO: 661 - protein, 58 aa, ARTIFICIAL SEQUENCE
  Engineered IL6 binding polypeptide
VDAKYAKEEREAWHEIHLLPNLTVTQMAAFIIKLFDDPSQSSELLSEAKKLNDSQAPK

SEQ ID NO: 662 - protein, 58 aa, ARTIFICIAL SEQUENCE
  Engineered IL6 binding polypeptide
VDAKYAKEEARAWWEIHLLPNLTVEQMAAFISKLFDDPSQSSELLSEAKKLNDSQAPK

SEQ ID NO: 663 - protein, 58 aa, ARTIFICIAL SEQUENCE
  Engineered IL6 binding polypeptide
VDAKYAKEERQAWWEIHILPNLTVTQMAAFISKLFDDPSQSSELLSEAKKLNDSQAPK

SEQ ID NO: 664 - protein, 58 aa, ARTIFICIAL SEQUENCE
  Engineered IL6 binding polypeptide
VDAKYAKEEAQAWREIHTLPNLTANQMAAFIIKLYDDPSQSSELLSEAKKLNDSQAPK

SEQ ID NO: 665 - protein, 58 aa, ARTIFICIAL SEQUENCE
  Engineered IL6 binding polypeptide
VDAKYAKEERHAWTEIHLLPNLTISQMAAFISKLFDDPSQSSELLSEAKKLNDSQAPK

SEQ ID NO: 666 - protein, 58 aa, ARTIFICIAL SEQUENCE
  Engineered IL6 binding polypeptide
VDAKYAKEEARAWWEIHMLPNLTVTQMAAFISKLFDDPSQSSELLSEAKKLNDSQAPK

SEQ ID NO: 667 - protein, 58 aa, ARTIFICIAL SEQUENCE
  Engineered IL6 binding polypeptide
VDAKYAKEEREAWWEIHLLPNLTAEQMAAFISKLFDDPSQSSELLSEAKKLNDSQAPK

SEQ ID NO: 668 - protein, 58 aa, ARTIFICIAL SEQUENCE
  Engineered IL6 binding polypeptide
VDAKYAKEEATAWWEIHLLPNLTVTQMAAFIQKLFDDPSQSSELLSEAKKLNDSQAPK

SEQ ID NO: 669 - protein, 58 aa, ARTIFICIAL SEQUENCE
  Engineered IL6 binding polypeptide
VDAKYAKEEAKAWHEIHLLPNLTVNQMAAFISKLFDDPSQSSELLSEAKKLNDSQAPK

SEQ ID NO: 670 - protein, 58 aa, ARTIFICIAL SEQUENCE
  Engineered IL6 binding polypeptide
VDAKYAKEERRAWYEIHLLPNLTITQMTAFISKLFDDPSQSSELLSEAKKLNDSQAPK

SEQ ID NO: 671 - protein, 58 aa, ARTIFICIAL SEQUENCE
  Engineered IL6 binding polypeptide
VDAKYAKEERRAWYEIHLLPNLTVHQIAAFISKLFDDPSQSSELLSEAKKLNDSQAPK

SEQ ID NO: 672 - protein, 58 aa, ARTIFICIAL SEQUENCE
  Engineered IL6 binding polypeptide
VDAKYAKEEHEAWWEIHLLPNLTVTQMAAFISKLFDDPSQSSELLSEAKKLNDSQAPK

SEQ ID NO: 673 - protein, 58 aa, ARTIFICIAL SEQUENCE
  Engineered IL6 binding polypeptide
VDAKYAKEERKAWTEIHSLPNLTVDQMSAFIIKLFDDPSQSSELLSEAKKLNDSQAPK

SEQ ID NO: 674 - protein, 58 aa, ARTIFICIAL SEQUENCE
  Engineered IL6 binding polypeptide
VDAKYAKEEAKAWFEIHLLPNLTINQMAAFISKLFDDPSQSSELLSEAKKLNDSQAPK

SEQ ID NO: 675 - protein, 58 aa, ARTIFICIAL SEQUENCE
  Engineered IL6 binding polypeptide
VDAKYAKEERDAWYEIHVLPNLTIEQMSAFISKLFDDPSQSSELLSEAKKLNDSQAPK

SEQ ID NO: 676 - protein, 58 aa, ARTIFICIAL SEQUENCE
  Engineered IL6 binding polypeptide
VDAKYAKEEAHAWWEIHALPNLTVTQMAAFISKLFDDPSQSSELLSEAKKLNDSQAPK

SEQ ID NO: 677 - protein, 58 aa, ARTIFICIAL SEQUENCE
  Engineered IL6 binding polypeptide
VDAKYAKEEAKAWYEIHLLPNLTVTQMAAFISKLFDDPSQSSELLSEAKKLNDSQAPK

SEQ ID NO: 678 - protein, 58 aa, ARTIFICIAL SEQUENCE
  Engineered IL6 binding polypeptide
VDAKYAKEERDAWWEIHKLPNLTVSQMAAFISKLFDDPSQSSELLSEAKKLNDSQAPK

SEQ ID NO: 679 - protein, 58 aa, ARTIFICIAL SEQUENCE
  Engineered IL6 binding polypeptide
VDAKYAKEERDAWYEIHLLPNLTVRQMAAFISKLFDDPSQSSELLSEAKKLNDSQAPK

SEQ ID NO: 680 - protein, 58 aa, ARTIFICIAL SEQUENCE
  Engineered IL6 binding polypeptide
VDAKYAKEERAAWWEIHLLPNLTVQQMAAFISKLFDDPSQSSELLSEAKKLNDSQAPK

SEQ ID NO: 681 - protein, 58 aa, ARTIFICIAL SEQUENCE
  Engineered IL6 binding polypeptide
VDAKYAKEEQQAWYEIHLLPNLTVTQMAAFIIKLFDDPSQSSELLSEAKKLNDSQAPK

SEQ ID NO: 682 - protein, 58 aa, ARTIFICIAL SEQUENCE
  Engineered IL6 binding polypeptide
VDAKYAKEEADAWFEIHILPNLTIDQMAAFIQKLFDDPSQSSELLSEAKKLNDSQAPK

SEQ ID NO: 683 - protein, 58 aa, ARTIFICIAL SEQUENCE
  Engineered IL6 binding polypeptide
VDAKYAKEEREAWHEIHTLPNLTVDQMAAFISKLFDDPSQSSELLSEAKKLNDSQAPK

SEQ ID NO: 684 - protein, 58 aa, ARTIFICIAL SEQUENCE
  Engineered IL6 binding polypeptide
VDAKYAKEEATAWFEIHTLPNLTVSQMAAFIWKLFDDPSQSSELLSEAKKLNDSQAPK

SEQ ID NO: 685 - protein, 58 aa, ARTIFICIAL SEQUENCE
  Engineered IL6 binding polypeptide
VDAKYAKEEAAAWHEIHILPNLTHHQMAAFIQKLFDDPSQSSELLSEAKKLNDSQAPK

SEQ ID NO: 686 - protein, 58 aa, ARTIFICIAL SEQUENCE
  Engineered IL6 binding polypeptide
VDAKYAKEERDAWFEIHALPNLTVNQMAAFIIKLYDDPSQSSELLSEAKKLNDSQAPK

SEQ ID NO: 687 - protein, 58 aa, ARTIFICIAL SEQUENCE
  Engineered IL6 binding polypeptide
VDAKYAKEERKAWYEIHLLPNLTTSQHAAFISKLFDDPSQSSELLSEAKKLNDSQAPK

SEQ ID NO: 688 - protein, 58 aa, ARTIFICIAL SEQUENCE
  Engineered IL6 binding polypeptide
VDAKYAKEERDAWYEIHLLPNLTVRQMSAFIIKLFDDPSQSSELLSEAKKLNDSQAPK

SEQ ID NO: 689 - protein, 58 aa, ARTIFICIAL SEQUENCE
  Engineered IL6 binding polypeptide
VDAKYAKEEAVAWHEIHALPNLTVDQMSAFISKLFDDPSQSSELLSEAKKLNDSQAPK

SEQ ID NO: 690 - protein, 58 aa, ARTIFICIAL SEQUENCE
  Engineered IL6 binding polypeptide
VDAKYAKEEAKAWFEIHALPNLTIEQMVAFISKLFDDPSQSSELLSEAKKLNDSQAPK

SEQ ID NO: 691 - protein, 58 aa, ARTIFICIAL SEQUENCE
  Engineered IL6 binding polypeptide
VDAKYAKEEADAWHEIHILPNLTVQQMAAFIQKLFDDPSQSSELLSEAKKLNDSQAPK

SEQ ID NO: 692 - protein, 58 aa, ARTIFICIAL SEQUENCE
  Engineered IL6 binding polypeptide
VDAKYAKEEAAAWWEIHSLPNLTVSQMAAFIWKLFDDPSQSSELLSEAKKLNDSQAPK

SEQ ID NO: 693 - protein, 58 aa, ARTIFICIAL SEQUENCE
  Engineered IL6 binding polypeptide
VDAKYAKEEAKAWHEIHTLPNLTVDQMAAFISKLFDDPSQSSELLSEAKKLNDSQAPK

SEQ ID NO: 694 - protein, 58 aa, ARTIFICIAL SEQUENCE
  Engineered IL6 binding polypeptide
VDAKYAKEEAQAWWEIHILPNLTVNQIAAFISKLFDDPSQSSELLSEAKKLNDSQAPK

SEQ ID NO: 695 - protein, 58 aa, ARTIFICIAL SEQUENCE
  Engineered IL6 binding polypeptide
VDAKYAKEERSAWFEIHVLPNLTIRQMSAFISKLFDDPSQSSELLSEAKKLNDSQAPK

SEQ ID NO: 696 - protein, 58 aa, ARTIFICIAL SEQUENCE
  Engineered IL6 binding polypeptide
VDAKYAKEERRAWLEIHLLPNLTVTQMTAFISKLFDDPSQSSELLSEAKKLNDSQAPK

SEQ ID NO: 697 - protein, 58 aa, ARTIFICIAL SEQUENCE
  Engineered IL6 binding polypeptide
VDAKYAKEERAAWFEIHLLPNLTATQIAAFISKLFDDPSQSSELLSEAKKLNDSQAPK

SEQ ID NO: 698 - protein, 58 aa, ARTIFICIAL SEQUENCE
  Engineered IL6 binding polypeptide
VDAKYAKEERAAWHEIHVLPNLTVDQMAAFISKLFDDPSQSSELLSEAKKLNDSQAPK

SEQ ID NO: 699 - protein, 58 aa, ARTIFICIAL SEQUENCE
  Engineered IL6 binding polypeptide
VDAKYAKEEARAWYEIHTLPNLTIHQMAAFISKLFDDPSQSSELLSEAKKLNDSQAPK

SEQ ID NO: 700 - protein, 58 aa, ARTIFICIAL SEQUENCE
  Engineered IL6 binding polypeptide
VDAKYAKEEAEAWFEIHALPNLTVHQMAAFIQKLFDDPSQSSELLSEAKKLNDSQAPK

SEQ ID NO: 701 - protein, 58 aa, ARTIFICIAL SEQUENCE
  Engineered IL6 binding polypeptide
VDAKYAKEERAAWYEIHSLPNLTTNQMAAFISKLFDDPSQSSELLSEAKKLNDSQAPK

SEQ ID NO: 702 - protein, 58 aa, ARTIFICIAL SEQUENCE
  Engineered IL6 binding polypeptide
VDAKYAKEEAKAWHEIHVLPNLTIEQRAAFISKLFDDPSQSSELLSEAKKLNDSQAPK

SEQ ID NO: 703 - protein, 58 aa, ARTIFICIAL SEQUENCE
  Engineered IL6 binding polypeptide
VDAKYAKEERTAWYEIHVLPNLTATQMAAFISKLFDDPSQSSELLSEAKKLNDSQAPK

SEQ ID NO: 704 - protein, 58 aa, ARTIFICIAL SEQUENCE
  Engineered IL6 binding polypeptide
VDAKYAKEERRAWWEIHLLPNLTVDQMSAFISKLFDDPSQSSELLSEAKKLNDSQAPK

SEQ ID NO: 705 - protein, 58 aa, ARTIFICIAL SEQUENCE
  Engineered IL6 binding polypeptide
VDAKYAKEEADAWREIHLLPNLTVTQTAAFISKLFDDPSQSSELLSEAKKLNDSQAPK

SEQ ID NO: 706 - protein, 58 aa, ARTIFICIAL SEQUENCE
  Engineered IL6 binding polypeptide
VDAKYAKEERDAWFEIHVLPNLTTEQMVAFISKLFDDPSQSSELLSEAKKLNDSQAPK

SEQ ID NO: 707 - protein, 58 aa, ARTIFICIAL SEQUENCE
  Engineered IL6 binding polypeptide
VDAKYAKEEQQAWYEIHVLPNLTVSQMAAFISKLFDDPSQSSELLSEAKKLNDSQAPK

SEQ ID NO: 708 - protein, 58 aa, ARTIFICIAL SEQUENCE
  Engineered IL6 binding polypeptide
VDAKYAKEERRAWFEIHALPNLTVNQMVAFISKLFDDPSQSSELLSEAKKLNDSQAPK

SEQ ID NO: 709 - protein, 58 aa, ARTIFICIAL SEQUENCE
  Engineered IL6 binding polypeptide
VDAKYAKEERKAWFEIHSLPNLTATQMHAFISKLFDDPSQSSELLSEAKKLNDSQAPK

SEQ ID NO: 710 - protein, 58 aa, ARTIFICIAL SEQUENCE
  Engineered IL6 binding polypeptide
VDAKYAKEEQQAWLEIHLLPNLTVEQMTAFIHKLYDDPSQSSELLSEAKKLNDSQAPK

SEQ ID NO: 711 - protein, 58 aa, ARTIFICIAL SEQUENCE
  Engineered IL6 binding polypeptide
VDAKYAKEEAEAWLEIHLLPNLTVHQMAAFISKLFDDPSQSSELLSEAKKLNDSQAPK

SEQ ID NO: 712 - protein, 58 aa, ARTIFICIAL SEQUENCE
  Engineered IL6 binding polypeptide
VDAKYAKEERDAWHEIHLLPNLTINQMTAFISKLFDDPSQSSELLSEAKKLNDSQAPK

SEQ ID NO: 713 - protein, 58 aa, ARTIFICIAL SEQUENCE
  Engineered IL6 binding polypeptide
VDAKYAKEERRAWYEIHILPNLTVHQMTAFIQKLLDDPSQSSELLSEAKKLNDSQAPK

SEQ ID NO: 714 - protein, 58 aa, ARTIFICIAL SEQUENCE
  Engineered IL6 binding polypeptide
VDAKYAKEEARAWHEIHLLPNLTVDQTTAFISKLFDDPSQSSELLSEAKKLNDSQAPK

SEQ ID NO: 715 - protein, 58 aa, ARTIFICIAL SEQUENCE
  Engineered IL6 binding polypeptide
VDAKYAKEERQAWREIHTLPNLTVHQMAAFISKLFDDPSQSSELLSEAKKLNDSQAPK

SEQ ID NO: 716 - protein, 58 aa, ARTIFICIAL SEQUENCE
  Engineered IL6 binding polypeptide
VDAKYAKEEHDAWREIHTLPNLTVSQMAAFISKLFDDPSQSSELLSEAKKLNDSQAPK

SEQ ID NO: 717 - protein, 58 aa, ARTIFICIAL SEQUENCE
  Engineered IL6 binding polypeptide
VDAKYAKEERAAWWEIHTLPNLTVHQMAAFISKLFDDPSQSSELLSEAKKLNDSQAPK

SEQ ID NO: 718 - protein, 58 aa, ARTIFICIAL SEQUENCE
  Engineered IL6 binding polypeptide
VDAKYAKEEAKAWHEIHALPNLTVSQMAAFISKLFDDPSQSSELLSEAKKLNDSQAPK

SEQ ID NO: 719 - protein, 58 aa, ARTIFICIAL SEQUENCE
  Engineered IL6 binding polypeptide
VDAKYAKEEAAAWWEIHTLPNLTVDQMAAFISKLFDDPSQSSELLSEAKKLNDSQAPK

SEQ ID NO: 720 - protein, 58 aa, ARTIFICIAL SEQUENCE
  Engineered IL6 binding polypeptide
VDAKYAKEERQAWFEIHKLPNLTVNQMAAFISKLFDDPSQSSELLSEAKKLNDSQAPK

SEQ ID NO: 721 - protein, 58 aa, ARTIFICIAL SEQUENCE
  Engineered IL6 binding polypeptide
VDAKYAKEERSAWREIHVLPNLTVNQRAAFISKLFDDPSQSSELLSEAKKLNDSQAPK

SEQ ID NO: 722 - protein, 58 aa, ARTIFICIAL SEQUENCE
  Engineered IL6 binding polypeptide
VDAKYAKEEAAAWHEIHLLPNLTVTQIAAFISKLFDDPSQSSELLSEAKKLNDSQAPK

SEQ ID NO: 723 - protein, 58 aa, ARTIFICIAL SEQUENCE
  Engineered IL6 binding polypeptide
VDAKYAKEEREAWAEIHKLPNLTATQMHAFISKLFDDPSQSSELLSEAKKLNDSQAPK

SEQ ID NO: 724 - protein, 58 aa, ARTIFICIAL SEQUENCE
  Engineered IL6 binding polypeptide
VDAKYAKEEQRAWSEIHSLPNLTVNQMAAFIMKLYDDPSQSSELLSEAKKLNDSQAPK

SEQ ID NO: 725 - protein, 58 aa, ARTIFICIAL SEQUENCE
  Engineered IL6 binding polypeptide
VDAKYAKEEAKAWWEIHVLPNLTIDQITAFIHKLYDDPSQSSELLSEAKKLNDSQAPK

SEQ ID NO: 726 - protein, 58 aa, ARTIFICIAL SEQUENCE
  Engineered IL6 binding polypeptide
VDAKYAKEEAQAWWEIHTLPNLTVDQMAAFISKLFDDPSQSSELLSEAKKLNDSQAPK

SEQ ID NO: 727 - protein, 58 aa, ARTIFICIAL SEQUENCE
  Engineered IL6 binding polypeptide
VDAKYAKEERRAWHEIHILPNLTTSQMAAFIQKLFDDPSQSSELLSEAKKLNDSQAPK

SEQ ID NO: 728 - protein, 58 aa, ARTIFICIAL SEQUENCE
  Engineered IL6 binding polypeptide
VDAKYAKEERSAWYEIHTLPNLTTNQRTAFISKLFDDPSQSSELLSEAKKLNDSQAPK

SEQ ID NO: 729 - protein, 58 aa, ARTIFICIAL SEQUENCE
  Engineered IL6 binding polypeptide
VDAKYAKEERRAWFEIHMLPNLTIDQMAAFISKLFDDPSQSSELLSEAKKLNDSQAPK

SEQ ID NO: 730 - protein, 58 aa, ARTIFICIAL SEQUENCE
  Engineered IL6 binding polypeptide
VDAKYAKEEAKAWYEIHALPNLTVDQMVAFITKLFDDPSQSSELLSEAKKLNDSQAPK

SEQ ID NO: 731 - protein, 58 aa, ARTIFICIAL SEQUENCE
  Engineered IL6 binding polypeptide
VDAKYAKEEHVAWLEIHLLPNLTAEQMAAFISKLYDDPSQSSELLSEAKKLNDSQAPK

SEQ ID NO: 732 - protein, 58 aa, ARTIFICIAL SEQUENCE
  Engineered IL6 binding polypeptide
VDAKYAKEERDAWFEIHALPNLTVQQMAAFISKLFDDPSQSSELLSEAKKLNDSQAPK

SEQ ID NO: 733 - protein, 58 aa, ARTIFICIAL SEQUENCE
  Engineered IL6 binding polypeptide
VDAKYAKEEARAWREIHLLPNLTVDQMAAFISKLFDDPSQSSELLSEAKKLNDSQAPK

SEQ ID NO: 734 - protein, 58 aa, ARTIFICIAL SEQUENCE
  Engineered IL6 binding polypeptide
VDAKYAKEEARAWWEIHMLPNLTINQMAAFISKLFDDPSQSSELLSEAKKLNDSQAPK

SEQ ID NO: 735 - protein, 58 aa, ARTIFICIAL SEQUENCE
  Engineered IL6 binding polypeptide
VDAKYAKEEAAAWLEIHKLPNLTVHQMAAFISKLFDDPSQSSELLSEAKKLNDSQAPK

SEQ ID NO: 736 - protein, 58 aa, ARTIFICIAL SEQUENCE
  Engineered IL6 binding polypeptide
VDAKYAKEERQAWFEIHVLPNLTTDQMAAFIHKLYDDPSQSSELLSEAKKLNDSQAPK

SEQ ID NO: 737 - protein, 58 aa, ARTIFICIAL SEQUENCE
  Engineered IL6 binding polypeptide
VDAKYAKEEQRAWTEIHLLPNLTVNQMAAFISKLFDDPSQSSELLSEAKKLNDSQAPK

SEQ ID NO: 738 - protein, 58 aa, ARTIFICIAL SEQUENCE
  Engineered IL6 binding polypeptide
VDAKYAKEEQQAWYEIHTLPNLTVQQMAAFIQKLFDDPSQSSELLSEAKKLNDSQAPK

SEQ ID NO: 739 - protein, 58 aa, ARTIFICIAL SEQUENCE
  Engineered IL6 binding polypeptide
VDAKYAKEEQHAWREIHILPNLTVTQIAAFISKLFDDPSQSSELLSEAKKLNDSQAPK

SEQ ID NO: 740 - protein, 58 aa, ARTIFICIAL SEQUENCE
  Engineered IL6 binding polypeptide
VDAKYAKEEQRAWYEIHLLPNLTVTQMAAFISKLFDDPSQSSELLSEAKKLNDSQAPK

SEQ ID NO: 741 - protein, 58 aa, ARTIFICIAL SEQUENCE
  Engineered IL6 binding polypeptide
VDAKYAKEERAAWFEIHSLPNLTVSQMAAFISKLFDDPSQSSELLSEAKKLNDSQAPK

SEQ ID NO: 742 - protein, 58 aa, ARTIFICIAL SEQUENCE
  Engineered IL6 binding polypeptide
VDAKYAKEERQAWYEIHILPNLTAEQMAAFISKLFDDPSQSSELLSEAKKLNDSQAPK

SEQ ID NO: 743 - protein, 58 aa, ARTIFICIAL SEQUENCE
  Engineered IL6 binding polypeptide
VDAKYAKEEAQAWWEIHVLPNLTVRQIVAFISKLFDDPSQSSELLSEAKKLNDSQAPK

SEQ ID NO: 744 - protein, 58 aa, ARTIFICIAL SEQUENCE
  Engineered IL6 binding polypeptide
VDAKYAKEERRAWFEIHTLPNLTVHQMTAFIQKLFDDPSQSSELLSEAKKLNDSQAPK

SEQ ID NO: 745 - protein, 58 aa, ARTIFICIAL SEQUENCE
  Engineered IL6 binding polypeptide
VDAKYAKEEQRAWHEIHLLPNLTTRQMAAFISKLFDDPSQSSELLSEAKKLNDSQAPK

SEQ ID NO: 746 - protein, 58 aa, ARTIFICIAL SEQUENCE
  Engineered IL6 binding polypeptide
VDAKYAKEERHAWHEIHILPNLTIEQMVAFISKLFDDPSQSSELLSEAKKLNDSQAPK

SEQ ID NO: 747 - protein, 58 aa, ARTIFICIAL SEQUENCE
  Engineered IL6 binding polypeptide
VDAKYAKEERQAWFEIHALPNLTVQQVEAFISKLFDDPSQSSELLSEAKKLNDSQAPK

SEQ ID NO: 748 - protein, 58 aa, ARTIFICIAL SEQUENCE
  Engineered IL6 binding polypeptide
VDAKYAKEEQRAWREIHLLPNLTVTQMAAFISKLFDDPSQSSELLSEAKKLNDSQAPK

SEQ ID NO: 749 - protein, 58 aa, ARTIFICIAL SEQUENCE
  Engineered IL6 binding polypeptide
VDAKYAKEERHAWWEIHSLPNLTISQMAAFISKLFDDPSQSSELLSEAKKLNDSQAPK

SEQ ID NO: 750 - protein, 58 aa, ARTIFICIAL SEQUENCE
  Engineered IL6 binding polypeptide
VDAKYAKEEARAWLEIHALPNLTVDQMAAFISKLFDDPSQSSELLSEAKKLNDSQAPK

SEQ ID NO: 751 - protein, 58 aa, ARTIFICIAL SEQUENCE
  Engineered IL6 binding polypeptide
VDAKYAKEEQRAWHEIHTLPNLTVRQMAAFIIKLFDDPSQSSELLSEAKKLNDSQAPK

SEQ ID NO: 752 - protein, 58 aa, ARTIFICIAL SEQUENCE
  Engineered IL6 binding polypeptide
VDAKYAKEERHAWFEIHKLPNLTVEQMAAFIWKLFDDPSQSSELLSEAKKLNDSQAPK

SEQ ID NO: 753 - protein, 58 aa, ARTIFICIAL SEQUENCE
  Engineered IL6 binding polypeptide
VDAKYAKEERDAWYEIHLLPNLTINQIAAFISKLFDDPSQSSELLSEAKKLNDSQAPK

SEQ ID NO: 754 - protein, 58 aa, ARTIFICIAL SEQUENCE
  Engineered IL6 binding polypeptide
VDAKYAKEERQAWHEIHILPNLTVTQMTAFISKLFDDPSQSSELLSEAKKLNDSQAPK

SEQ ID NO: 755 - protein, 58 aa, ARTIFICIAL SEQUENCE
  Engineered IL6 binding polypeptide
VDAKYAKEERQAWTEIHSLPNLTATQVAAFIQKLFDDPSQSSELLSEAKKLNDSQAPK

SEQ ID NO: 756 - protein, 58 aa, ARTIFICIAL SEQUENCE
  Engineered IL6 binding polypeptide
VDAKYAKEEREAWWEIHHLPNLTVHQRAAFISKLFDDPSQSSELLSEAKKLNDSQAPK

SEQ ID NO: 757 - protein, 58 aa, ARTIFICIAL SEQUENCE
  Engineered IL6 binding polypeptide
VDAKYAKEERAAWYEIHTLPNLTVSQMTAFISKLFDDPSQSSELLSEAKKLNDSQAPK

SEQ ID NO: 758 - protein, 58 aa, ARTIFICIAL SEQUENCE
  Engineered IL6 binding polypeptide
VDAKYAKEEHQAWWEIHLLPNLTARQMEAFIQKLFDDPSQSSELLSEAKKLNDSQAPK

SEQ ID NO: 759 - protein, 58 aa, ARTIFICIAL SEQUENCE
  Engineered IL6 binding polypeptide
VDAKYAKEEAHAWTEIHLLPNLTVDQMVAFISKLFDDPSQSSELLSEAKKLNDSQAPK

SEQ ID NO: 760 - protein, 58 aa, ARTIFICIAL SEQUENCE
  Engineered IL6 binding polypeptide
VDAKYAKEERRAWHEIHLLPNLTIQQIAAFISKLFDDPSQSSELLSEAKKLNDSQAPK

SEQ ID NO: 761 - protein, 58 aa, ARTIFICIAL SEQUENCE
  Engineered IL6 binding polypeptide
VDAKYAKEEHDAWFEIHTLPNLTVEQMAAFIMKLFDDPSQSSELLSEAKKLNDSQAPK

SEQ ID NO: 762 - protein, 58 aa, ARTIFICIAL SEQUENCE
  Engineered IL6 binding polypeptide
VDAKYAKEEHRAWLEIHLLPNLTVRQMAAFISKLFDDPSQSSELLSEAKKLNDSQAPK

SEQ ID NO: 763 - protein, 58 aa, ARTIFICIAL SEQUENCE
  Engineered IL6 binding polypeptide
VDAKYAKEEAKAWWEIHLLPNLTVDQMAAFISKLFDDPSQSSELLSEAKKLNDSQAPK

SEQ ID NO: 764 - protein, 58 aa, ARTIFICIAL SEQUENCE
  Engineered IL6 binding polypeptide
VDAKYAKEERKAWHEIHVLPNLTTNQRVAFIMKLMDDPSQSSELLSEAKKLNDSQAPK

SEQ ID NO: 765 - protein, 58 aa, ARTIFICIAL SEQUENCE
  Engineered IL6 binding polypeptide
VDAKYAKEERRAWWEIHILPNLTVEQAAAFISKLFDDPSQSSELLSEAKKLNDSQAPK

SEQ ID NO: 766 - protein, 58 aa, ARTIFICIAL SEQUENCE
  Engineered IL6 binding polypeptide
VDAKYAKEEAAAWYEIHTLPNLTIDQMAAFISKLFDDPSQSSELLSEAKKLNDSQAPK

SEQ ID NO: 767 - protein, 58 aa, ARTIFICIAL SEQUENCE
  Engineered IL6 binding polypeptide
VDAKYAKEERAAWFEIHKLPNLTVSQMAAFIQKLFDDPSQSSELLSEAKKLNDSQAPK

SEQ ID NO: 768 - protein, 58 aa, ARTIFICIAL SEQUENCE
  Engineered IL6 binding polypeptide
VDAKYAKEEAEAWTEIHKLPNLTVHQMTAFIIKLFDDPSQSSELLSEAKKLNDSQAPK

SEQ ID NO: 769 - protein, 58 aa, ARTIFICIAL SEQUENCE
  Engineered IL6 binding polypeptide
VDAKYAKEERHAWWEIHKLPNLTISQMAAFISKLFDDPSQSSELLSEAKKLNDSQAPK

SEQ ID NO: 770 - protein, 58 aa, ARTIFICIAL SEQUENCE
  Engineered IL6 binding polypeptide
VDAKYAKEERKAWYEIHLLPNLTTSQRVAFISKLFDDPSQSSELLSEAKKLNDSQAPK

SEQ ID NO: 771 - protein, 58 aa, ARTIFICIAL SEQUENCE
  Engineered IL6 binding polypeptide
VDAKYAKEEASAWWEIHVLPNLTVNQIAAFISKLFDDPSQSSELLSEAKKLNDSQAPK

SEQ ID NO: 772 - protein, 58 aa, ARTIFICIAL SEQUENCE
  Engineered IL6 binding polypeptide
VDAKYAKEERDAWYEIHLLPNLTTDQMAAFISKLFDDPSQSSELLSEAKKLNDSQAPK

SEQ ID NO: 773 - protein, 58 aa, ARTIFICIAL SEQUENCE
  Engineered IL6 binding polypeptide
VDAKYAKEEAEAWLEIHLLPNLTVQQMAAFISKLFDDPSQSSELLSEAKKLNDSQAPK

SEQ ID NO: 774 - protein, 58 aa, ARTIFICIAL SEQUENCE
  Engineered IL6 binding polypeptide
VDAKYAKEEAKAWHEIHVLPNLTVRQIAAFISKLFDDPSQSSELLSEAKKLNDSQAPK

SEQ ID NO: 775 - protein, 58 aa, ARTIFICIAL SEQUENCE
  Engineered IL6 binding polypeptide
VDAKYAKEEASAWFEIHTLPNLTVDQMSAFIIKLFDDPSQSSELLSEAKKLNDSQAPK

SEQ ID NO: 776 - protein, 58 aa, ARTIFICIAL SEQUENCE
  Engineered IL6 binding polypeptide
VDAKYAKEERKAWYEIHVLPNLTVEQIAAFISKLFDDPSQSSELLSEAKKLNDSQAPK

SEQ ID NO: 777 - protein, 58 aa, ARTIFICIAL SEQUENCE
  Engineered IL6 binding polypeptide
VDAKYAKEERAAWHEIHVLPNLTTEQRVAFIIKLYDDPSQSSELLSEAKKLNDSQAPK

SEQ ID NO: 778 - protein, 58 aa, ARTIFICIAL SEQUENCE
  Engineered IL6 binding polypeptide
VDAKYAKEEAQAWYEIHVLPNLTVRQMVAFISKLFDDPSQSSELLSEAKKLNDSQAPK

SEQ ID NO: 779 - protein, 58 aa, ARTIFICIAL SEQUENCE
  Engineered IL6 binding polypeptide
VDAKYAKEEAQAWWEIHLLPNLTVRQIAAFISKLFDDPSQSSELLSEAKKLNDSQAPK

SEQ ID NO: 780 - protein, 58 aa, ARTIFICIAL SEQUENCE
  Engineered IL6 binding polypeptide
VDAKYAKEEAAAWTEIHALPNLTVHQMAAFISKLFDDPSQSSELLSEAKKLNDSQAPK

SEQ ID NO: 781 - protein, 58 aa, ARTIFICIAL SEQUENCE
  Engineered IL6 binding polypeptide
VDAKYAKEERTAWWEIHALPNLTIDQMAAFIIKLYDDPSQSSELLSEAKKLNDSQAPK

SEQ ID NO: 782 - protein, 58 aa, ARTIFICIAL SEQUENCE
  Engineered IL6 binding polypeptide
VDAKYAKEEHKAWREIHLLPNLTTEQMTAFISKLFDDPSQSSELLSEAKKLNDSQAPK

SEQ ID NO: 783 - protein, 58 aa, ARTIFICIAL SEQUENCE
  Engineered IL6 binding polypeptide
VDAKYAKEEQRAWREIHLLPNLTVNQMAAFITKLFDDPSQSSELLSEAKKLNDSQAPK

SEQ ID NO: 784 - protein, 58 aa, ARTIFICIAL SEQUENCE
  Engineered IL6 binding polypeptide
VDAKYAKEERHAWWEIHKLPNLTIRQMAAFISKLFDDPSQSSELLSEAKKLNDSQAPK

SEQ ID NO: 785 - protein, 58 aa, ARTIFICIAL SEQUENCE
  Engineered IL6 binding polypeptide
VDAKYAKEEARAWHEIHILPNLTVRQISAFISKLFDDPSQSSELLSEAKKLNDSQAPK

SEQ ID NO: 786 - protein, 58 aa, ARTIFICIAL SEQUENCE
  Engineered IL6 binding polypeptide
VDAKYAKEERQAWFEIHALPNLTVNQMAAFIIKLYDDPSQSSELLSEAKKLNDSQAPK

SEQ ID NO: 787 - protein, 58 aa, ARTIFICIAL SEQUENCE
  Engineered IL6 binding polypeptide
VDAKYAKEEAQAWSEIHLLPNLTIDQRVAFISKLFDDPSQSSELLSEAKKLNDSQAPK

SEQ ID NO: 788 - protein, 58 aa, ARTIFICIAL SEQUENCE
  Engineered IL6 binding polypeptide
VDAKYAKEERHAWHEIHILPNLTINQMAAFISKLFDDPSQSSELLSEAKKLNDSQAPK

SEQ ID NO: 789 - protein, 58 aa, ARTIFICIAL SEQUENCE
  Engineered IL6 binding polypeptide
VDAKYAKEEAKAWAEIHALPNLTVTQMSAFIQKLFDDPSQSSELLSEAKKLNDSQAPK

SEQ ID NO: 790 - protein, 58 aa, ARTIFICIAL SEQUENCE
  Engineered IL6 binding polypeptide
VDAKYAKEERQAWFEIHILPNLTATQMAAFISKLFDDPSQSSELLSEAKKLNDSQAPK

SEQ ID NO: 791 - protein, 58 aa, ARTIFICIAL SEQUENCE
  Engineered IL6 binding polypeptide
VDAKYAKEERRAWHEIHVLPNLTVRQMAAFISKLFDDPSQSSELLSEAKKLNDSQAPK

SEQ ID NO: 792 - protein, 58 aa, ARTIFICIAL SEQUENCE
  Engineered IL6 binding polypeptide
VDAKYAKEEAHAWFEIHILPNLTIDQRSAFISKLFDDPSQSSELLSEAKKLNDSQAPK

SEQ ID NO: 793 - protein, 58 aa, ARTIFICIAL SEQUENCE
  Engineered IL6 binding polypeptide
VDAKYAKEEARAWWEIHLLPNLTIRQMTAFISKLFDDPSQSSELLSEAKKLNDSQAPK

SEQ ID NO: 794 - protein, 58 aa, ARTIFICIAL SEQUENCE
  Engineered IL6 binding polypeptide
VDAKYAKEEAEAWHEIHVLPNLTVSQMAAFISKLFDDPSQSSELLSEAKKLNDSQAPK

SEQ ID NO: 795 - protein, 58 aa, ARTIFICIAL SEQUENCE
  Engineered IL6 binding polypeptide
VDAKYAKEERQAWREIHLLPNLTTDQMSAFISKLFDDPSQSSELLSEAKKLNDSQAPK

SEQ ID NO: 796 - protein, 58 aa, ARTIFICIAL SEQUENCE
  Engineered IL6 binding polypeptide
VDAKYAKEEATAWREIHLLPNLTVDQMAAFISKLFDDPSQSSELLSEAKKLNDSQAPK

SEQ ID NO: 797 - protein, 58 aa, ARTIFICIAL SEQUENCE
  Engineered IL6 binding polypeptide
VDAKYAKEERQAWWEIHKLPNLTVTQMAAFISKLFDDPSQSSELLSEAKKLNDSQAPK

SEQ ID NO: 798 - protein, 58 aa, ARTIFICIAL SEQUENCE
  Engineered IL6 binding polypeptide
VDAKYAKEEARAWREIHLLPNLTISQMAAFISKLFDDPSQSSELLSEAKKLNDSQAPK

SEQ ID NO: 799 - protein, 58 aa, ARTIFICIAL SEQUENCE
  Engineered IL6 binding polypeptide
VDAKYAKEEAEAWHEIHVLPNLTVEQMAAFISKLFDDPSQSSELLSEAKKLNDSQAPK

SEQ ID NO: 800 - protein, 58 aa, ARTIFICIAL SEQUENCE
  Engineered IL6 binding polypeptide
VDAKYAKEEAAAWLEIHLLPNLTIDQMAAFISKLFDDPSQSSELLSEAKKLNDSQAPK

SEQ ID NO: 801 - protein, 58 aa, ARTIFICIAL SEQUENCE
  Engineered IL6 binding polypeptide
VDAKYAKEERDAWYEIHLLPNLTVQQMSAFISKLFDDPSQSSELLSEAKKLNDSQAPK

SEQ ID NO: 802 - protein, 58 aa, ARTIFICIAL SEQUENCE
  Engineered IL6 binding polypeptide
VDAKYAKEERAAWFEIHTLPNLTVHQMAAFISKLFDDPSQSSELLSEAKKLNDSQAPK

SEQ ID NO: 803 - protein, 58 aa, ARTIFICIAL SEQUENCE
  Engineered IL6 binding polypeptide
VDAKYAKEEQSAWHEIHTLPNLTVNQMAAFIIKLFDDPSQSSELLSEAKKLNDSQAPK

SEQ ID NO: 804 - protein, 58 aa, ARTIFICIAL SEQUENCE
  Engineered IL6 binding polypeptide
VDAKYAKEERSAWFEIHILPNLTVRQMAAFIQKLFDDPSQSSELLSEAKKLNDSQAPK

SEQ ID NO: 805 - protein, 58 aa, ARTIFICIAL SEQUENCE
  Engineered IL6 binding polypeptide
VDAKYAKEEAQAWHEIHVLPNLTVNQMAAFISKLFDDPSQSSELLSEAKKLNDSQAPK

SEQ ID NO: 806 - protein, 58 aa, ARTIFICIAL SEQUENCE
  Engineered IL6 binding polypeptide
VDAKYAKEEAHAWREIHLLPNLTVSQMAAFIIKLFDDPSQSSELLSEAKKLNDSQAPK

SEQ ID NO: 807 - protein, 58 aa, ARTIFICIAL SEQUENCE
  Engineered IL6 binding polypeptide
VDAKYAKEEARAWREIHLLPNLTVQQMAAFIQKLFDDPSQSSELLSEAKKLNDSQAPK

SEQ ID NO: 808 - protein, 58 aa, ARTIFICIAL SEQUENCE
  Engineered IL6 binding polypeptide
VDAKYAKEERQAWYEIHMLPNLTITQLEAFISKLFDDPSQSSELLSEAKKLNDSQAPK

SEQ ID NO: 809 - protein, 58 aa, ARTIFICIAL SEQUENCE
  Engineered IL6 binding polypeptide
VDAKYAKEEREAWYEIHVLPNLTHHQMEAFIQKLFDDPSQSSELLSEAKKLNDSQAPK

SEQ ID NO: 810 - protein, 58 aa, ARTIFICIAL SEQUENCE
  Engineered IL6 binding polypeptide
VDAKYAKEERRAWFEIHLLPNLTVTQISAFISKLFDDPSQSSELLSEAKKLNDSQAPK

SEQ ID NO: 811 - protein, 58 aa, ARTIFICIAL SEQUENCE
  Engineered IL6 binding polypeptide
VDAKYAKEEREAWFEIHALPNLTVDQMSAFIIKLYDDPSQSSELLSEAKKLNDSQAPK

SEQ ID NO: 812 - protein, 58 aa, ARTIFICIAL SEQUENCE
  Engineered IL6 binding polypeptide
VDAKYAKEEREAWWEIHLLPNLTVEQMAAFIHKLYDDPSQSSELLSEAKKLNDSQAPK

SEQ ID NO: 813 - protein, 58 aa, ARTIFICIAL SEQUENCE
  Engineered IL6 binding polypeptide
VDAKYAKEEREAWHEIHTLPNLTVHQRAAFISKLFDDPSQSSELLSEAKKLNDSQAPK

SEQ ID NO: 814 - protein, 58 aa, ARTIFICIAL SEQUENCE
  Engineered IL6 binding polypeptide
VDAKYAKEEAQAWHEIHTLPNLTVDQMAAFISKLFDDPSQSSELLSEAKKLNDSQAPK

SEQ ID NO: 815 - protein, 58 aa, ARTIFICIAL SEQUENCE
  Engineered IL6 binding polypeptide
VDAKYAKEEQHAWYEIHILPNLTVTQMAAFISKLFDDPSQSSELLSEAKKLNDSQAPK

SEQ ID NO: 816 - protein, 58 aa, ARTIFICIAL SEQUENCE
  Engineered IL6 binding polypeptide
VDAKYAKEEHHAWYEIHTLPNLTIQQMAAFISKLFDDPSQSSELLSEAKKLNDSQAPK

SEQ ID NO: 817 - protein, 58 aa, ARTIFICIAL SEQUENCE
  Engineered IL6 binding polypeptide
VDAKYAKEEAHAWYEIHLLPNLTVNQMAAFIQKLFDDPSQSSELLSEAKKLNDSQAPK

SEQ ID NO: 818 - protein, 58 aa, ARTIFICIAL SEQUENCE
  Engineered IL6 binding polypeptide
VDAKYAKEEAAAWREIHTLPNLTAEQMAAFISKLFDDPSQSSELLSEAKKLNDSQAPK

SEQ ID NO: 819 - protein, 58 aa, ARTIFICIAL SEQUENCE
  Engineered IL6 binding polypeptide
VDAKYAKEEASAWYEIHLLPNLTVEQMAAFISKLFDDPSQSSELLSEAKKLNDSQAPK

SEQ ID NO: 820 - protein, 58 aa, ARTIFICIAL SEQUENCE
  Engineered IL6 binding polypeptide
VDAKYAKEERKAWYEIHVLPNLTVDQMAAFIQKLFDDPSQSSELLSEAKKLNDSQAPK

SEQ ID NO: 821 - protein, 58 aa, ARTIFICIAL SEQUENCE
  Engineered IL6 binding polypeptide
VDAKYAKEEAHAWHEIHILPNLTVNQIAAFISKLFDDPSQSSELLSEAKKLNDSQAPK

SEQ ID NO: 822 - protein, 58 aa, ARTIFICIAL SEQUENCE
  Engineered IL6 binding polypeptide
VDAKYAKEERRAWAEIHKLPNLTISQIAAFISKLFDDPSQSSELLSEAKKLNDSQAPK

SEQ ID NO: 823 - protein, 58 aa, ARTIFICIAL SEQUENCE
  Engineered IL6 binding polypeptide
VDAKYAKEEAHAWLEIHALPNLTIEQISAFIIKLYDDPSQSSELLSEAKKLNDSQAPK

SEQ ID NO: 824 - protein, 58 aa, ARTIFICIAL SEQUENCE
  Engineered IL6 binding polypeptide
VDAKYAKEERTAWYEIHILPNLTIQQMAAFISKLFDDPSQSSELLSEAKKLNDSQAPK

SEQ ID NO: 825 - protein, 58 aa, ARTIFICIAL SEQUENCE
  Engineered IL6 binding polypeptide
VDAKYAKEERHAWYEIHLLPNLTVTQMAAFISKLFDDPSQSSELLSEAKKLNDSQAPK

SEQ ID NO: 826 - protein, 58 aa, ARTIFICIAL SEQUENCE
  Engineered IL6 binding polypeptide
VDAKYAKEERRAWYEIHLLPNLTVEQIAAFISKLFDDPSQSSELLSEAKKLNDSQAPK

SEQ ID NO: 827 - protein, 58 aa, ARTIFICIAL SEQUENCE
  Engineered IL6 binding polypeptide
VDAKYAKEERDAWFEIHALPNLTVTQVAAFISKLFDDPSQSSELLSEAKKLNDSQAPK

SEQ ID NO: 828 - protein, 58 aa, ARTIFICIAL SEQUENCE
  Engineered IL6 binding polypeptide
VDAKYAKEEQEAWTEIHTLPNLTIDQMTAFIIKLFDDPSQSSELLSEAKKLNDSQAPK

SEQ ID NO: 829 - protein, 58 aa, ARTIFICIAL SEQUENCE
  Engineered IL6 binding polypeptide
VDAKYAKEEREAWWEIHALPNLTTNQIAAFISKLFDDPSQSSELLSEAKKLNDSQAPK

SEQ ID NO: 830 - protein, 58 aa, ARTIFICIAL SEQUENCE
  Engineered IL6 binding polypeptide
VDAKYAKEERAAWYEIHLLPNLTVNQMAAFISKLFDDPSQSSELLSEAKKLNDSQAPK

SEQ ID NO: 831 - protein, 58 aa, ARTIFICIAL SEQUENCE
  Engineered IL6 binding polypeptide
VDAKYAKEEAKAWYEIHILPNLTVTQIAAFISKLFDDPSQSSELLSEAKKLNDSQAPK

SEQ ID NO: 832 - protein, 58 aa, ARTIFICIAL SEQUENCE
  Engineered IL6 binding polypeptide
VDAKYAKEEREAWHEIHILPNLTVNQMAAFISKLFDDPSQSSELLSEAKKLNDSQAPK

SEQ ID NO: 833 - protein, 58 aa, ARTIFICIAL SEQUENCE
  Engineered IL6 binding polypeptide
VDAKYAKEERAAWREIHLLPNLTVSQMEAFISKLFDDPSQSSELLSEAKKLNDSQAPK

SEQ ID NO: 834 - protein, 58 aa, ARTIFICIAL SEQUENCE
  Engineered IL6 binding polypeptide
VDAKYAKEERTAWFEIHTLPNLTVQQMAAFIIKLFDDPSQSSELLSEAKKLNDSQAPK

SEQ ID NO: 835 - protein, 58 aa, ARTIFICIAL SEQUENCE
  Engineered IL6 binding polypeptide
VDAKYAKEEREAWHEIHILPNLTIEQMAAFIQKLFDDPSQSSELLSEAKKLNDSQAPK

SEQ ID NO: 836 - protein, 58 aa, ARTIFICIAL SEQUENCE
  Engineered IL6 binding polypeptide
VDAKYAKEERQAWYEIHILPNLTVRQISAFISKLFDDPSQSSELLSEAKKLNDSQAPK

SEQ ID NO: 837 - protein, 58 aa, ARTIFICIAL SEQUENCE
  Engineered IL6 binding polypeptide
VDAKYAKEEAQAWTEIHILPNLTVSQMAAFIQKLFDDPSQSSELLSEAKKLNDSQAPK

SEQ ID NO: 838 - protein, 58 aa, ARTIFICIAL SEQUENCE
  Engineered IL6 binding polypeptide
VDAKYAKEEHDAWYEIHTLPNLTVDQVSAFISKLFDDPSQSSELLSEAKKLNDSQAPK

SEQ ID NO: 839 - protein, 58 aa, ARTIFICIAL SEQUENCE
  Engineered IL6 binding polypeptide
VDAKYAKEEAEAWREIHLLPNLTINQIAAFISKLFDDPSQSSELLSEAKKLNDSQAPK

SEQ ID NO: 840 - protein, 58 aa, ARTIFICIAL SEQUENCE
  Engineered IL6 binding polypeptide
VDAKYAKEEQSAWTEIHTLPNLTTDQRVAFISKLFDDPSQSSELLSEAKKLNDSQAPK

SEQ ID NO: 841 - protein, 58 aa, ARTIFICIAL SEQUENCE
  Engineered IL6 binding polypeptide
VDAKYAKEERDAWHEIHLLPNLTIEQRAAFISKLFDDPSQSSELLSEAKKLNDSQAPK

SEQ ID NO: 842 - protein, 58 aa, ARTIFICIAL SEQUENCE
  Engineered IL6 binding polypeptide
VDAKYAKEEARAWHEIHVLPNLTTDQRVAFISKLFDDPSQSSELLSEAKKLNDSQAPK

SEQ ID NO: 843 - protein, 58 aa, ARTIFICIAL SEQUENCE
  Engineered IL6 binding polypeptide
VDAKYAKEEADAWFEIHMLPNLTIDQMTAFIMKLFDDPSQSSELLSEAKKLNDSQAPK

SEQ ID NO: 844 - protein, 58 aa, ARTIFICIAL SEQUENCE
  Engineered IL6 binding polypeptide
VDAKYAKEEAEAWWEIHALPNLTVSQTAAFISKLFDDPSQSSELLSEAKKLNDSQAPK

SEQ ID NO: 845 - protein, 58 aa, ARTIFICIAL SEQUENCE
  Engineered IL6 binding polypeptide
VDAKYAKEERDAWFEIHALPNLTISQMTAFIIKLYDDPSQSSELLSEAKKLNDSQAPK

SEQ ID NO: 846 - protein, 58 aa, ARTIFICIAL SEQUENCE
  Engineered IL6 binding polypeptide
VDAKYAKEERRAWYEIHTLPNLTVSQMAAFISKLFDDPSQSSELLSEAKKLNDSQAPK

SEQ ID NO: 847 - protein, 58 aa, ARTIFICIAL SEQUENCE
  Engineered IL6 binding polypeptide
VDAKYAKEEREAWYEIHLLPNLTTRQMAAFIIKLFDDPSQSSELLSEAKKLNDSQAPK

SEQ ID NO: 848 - protein, 58 aa, ARTIFICIAL SEQUENCE
  Engineered IL6 binding polypeptide
VDAKYAKEEHDAWYEIHVLPNLTVNQIAAFISKLFDDPSQSSELLSEAKKLNDSQAPK

SEQ ID NO: 849 - protein, 58 aa, ARTIFICIAL SEQUENCE
  Engineered IL6 binding polypeptide
VDAKYAKEEAHAWAEIHSLPNLTVDQMVAFIQKLFDDPSQSSELLSEAKKLNDSQAPK

SEQ ID NO: 850 - protein, 58 aa, ARTIFICIAL SEQUENCE
  Engineered IL6 binding polypeptide
VDAKYAKEEREAWWEIHKLPNLTVTQMAAFIQKLFDDPSQSSELLSEAKKLNDSQAPK

SEQ ID NO: 851 - protein, 58 aa, ARTIFICIAL SEQUENCE
  Engineered IL6 binding polypeptide
VDAKYAKEERVAWYEIHLLPNLTIDQMAAFISKLFDDPSQSSELLSEAKKLNDSQAPK

SEQ ID NO: 852 - protein, 58 aa, ARTIFICIAL SEQUENCE
  Engineered IL6 binding polypeptide
VDAKYAKEEARAWHEIHILPNLTVSQITAFISKLFDDPSQSSELLSEAKKLNDSQAPK

SEQ ID NO: 853 - protein, 58 aa, ARTIFICIAL SEQUENCE
  Engineered IL6 binding polypeptide
VDAKYAKEEADAWREIHLLPNLTASQMAAFISKLFDDPSQSSELLSEAKKLNDSQAPK

SEQ ID NO: 854 - protein, 58 aa, ARTIFICIAL SEQUENCE
  Engineered IL6 binding polypeptide
VDAKYAKEEREAWTEIHSLPNLTVDQMAAFIIKLYDDPSQSSELLSEAKKLNDSQAPK

SEQ ID NO: 855 - protein, 58 aa, ARTIFICIAL SEQUENCE
  Engineered IL6 binding polypeptide
VDAKYAKEERRAWYEIHLLPNLTIEQMAAFISKLFDDPSQSSELLSEAKKLNDSQAPK

SEQ ID NO: 856 - protein, 58 aa, ARTIFICIAL SEQUENCE
  Engineered IL6 binding polypeptide
VDAKYAKEEREAWYEIHLLPNLTIDQMAAFISKLFDDPSQSSELLSEAKKLNDSQAPK

SEQ ID NO: 857 - protein, 58 aa, ARTIFICIAL SEQUENCE
  Engineered IL6 binding polypeptide
VDAKYAKEEARAWYEIHILPNLTVSQMAAFISKLFDDPSQSSELLSEAKKLNDSQAPK

SEQ ID NO: 858 - protein, 58 aa, ARTIFICIAL SEQUENCE
  Engineered IL6 binding polypeptide
VDAKYAKEERQAWHEIHTLPNLTTDQMAAFISKLFDDPSQSSELLSEAKKLNDSQAPK

SEQ ID NO: 859 - protein, 58 aa, ARTIFICIAL SEQUENCE
  Engineered IL6 binding polypeptide
VDAKYAKEEHDAWWEIHKLPNLTVNQTAAFISKLFDDPSQSSELLSEAKKLNDSQAPK

SEQ ID NO: 860 - protein, 58 aa, ARTIFICIAL SEQUENCE
  Engineered IL6 binding polypeptide
VDAKYAKEERTAWHEIHSLPNLTIDQMAAFIIKLFDDPSQSSELLSEAKKLNDSQAPK

SEQ ID NO: 861 - protein, 58 aa, ARTIFICIAL SEQUENCE
  Engineered IL6 binding polypeptide
VDAKYAKEERAAWWEIHLLPNLTTTQMAAFISKLFDDPSQSSELLSEAKKLNDSQAPK

SEQ ID NO: 862 - protein, 58 aa, ARTIFICIAL SEQUENCE
  Engineered IL6 binding polypeptide
VDAKYAKEERDAWREIHLLPNLTIDQMAAFISKLFDDPSQSSELLSEAKKLNDSQAPK

SEQ ID NO: 863 - protein, 58 aa, ARTIFICIAL SEQUENCE
  Engineered IL6 binding polypeptide
VDAKYAKEEQVAWHEIHLLPNLTIDQMTAFISKLFDDPSQSSELLSEAKKLNDSQAPK

SEQ ID NO: 864 - protein, 58 aa, ARTIFICIAL SEQUENCE
  Engineered IL6 binding polypeptide
VDAKYAKEEAQAWREIHLLPNLTVDQMAAFISKLFDDPSQSSELLSEAKKLNDSQAPK

SEQ ID NO: 865 - protein, 58 aa, ARTIFICIAL SEQUENCE
  Engineered IL6 binding polypeptide
VDAKYAKEEAKAWFEIHILPNLTVQQVAAFISKLFDDPSQSSELLSEAKKLNDSQAPK

SEQ ID NO: 866 - protein, 58 aa, ARTIFICIAL SEQUENCE
  Engineered IL6 binding polypeptide
VDAKYAKEEHAAWREITLLPNLTINQRAAFISKLFDDPSQSSELLSEAKKLNDSQAPK

SEQ ID NO: 867 - protein, 58 aa, ARTIFICIAL SEQUENCE
  Engineered IL6 binding polypeptide
VDAKYAKEEAEAWSEIHKLPNLTVTQMAAFISKLFDDPSQSSELLSEAKKLNDSQAPK

SEQ ID NO: 868 - protein, 58 aa, ARTIFICIAL SEQUENCE
  Engineered IL6 binding polypeptide
VDAKYAKEEQQAWYEIHLLPNLTVTQMSAFISKLFDDPSQSSELLSEAKKLNDSQAPK

SEQ ID NO: 869 - protein, 58 aa, ARTIFICIAL SEQUENCE
  Engineered IL6 binding polypeptide
VDAKYAKEEARAWYEIHLLPNLTIEQMAAFISKLFDDPSQSSELLSEAKKLNDSQAPK

SEQ ID NO: 870 - protein, 58 aa, ARTIFICIAL SEQUENCE
  Engineered IL6 binding polypeptide
VDAKYAKEEAEAWTEIHLLPNLTVEQRVAFISKLFDDPSQSSELLSEAKKLNDSQAPK

SEQ ID NO: 871 - protein, 58 aa, ARTIFICIAL SEQUENCE
  Engineered IL6 binding polypeptide
VDAKYAKEERQAWTEIHLLPNLTVEQMAAFIQKLFDDPSQSSELLSEAKKLNDSQAPK

SEQ ID NO: 872 - protein, 58 aa, ARTIFICIAL SEQUENCE
  Engineered IL6 binding polypeptide
VDAKYAKEEYYAWTEIHKLPNLTIDQMAAFITKLFDDPSQSSELLSEAKKLNDSQAPK

SEQ ID NO: 873 - protein, 58 aa, ARTIFICIAL SEQUENCE
  Engineered IL6 binding polypeptide
VDAKYAKEEQAAWMEIHLLPNLTIDQMAAFITKLFDDPSQSSELLSEAKKLNDSQAPK

SEQ ID NO: 874 - protein, 58 aa, ARTIFICIAL SEQUENCE
  Engineered IL6 binding polypeptide
VDAKYAKEEYAAWTEIHLLPNLTIDQMAAFITKLFDDPSQSSELLSEAKKLNDSQAPK

SEQ ID NO: 875 - protein, 58 aa, ARTIFICIAL SEQUENCE
  Engineered IL6 binding polypeptide
VDAKYAKEEKEAWYEIHILPNLTISQMAAFITKLFDDPSQSSELLSEAKKLNDSQAPK

SEQ ID NO: 876 - protein, 58 aa, ARTIFICIAL SEQUENCE
  Engineered IL6 binding polypeptide
VDAKYAKEEREAWYEIHLLPNLTIVQMAAFISKLFDDPSQSSELLSEAKKLNDSQAPK

SEQ ID NO: 877 - protein, 58 aa, ARTIFICIAL SEQUENCE
  Engineered IL6 binding polypeptide
VDAKYAKEEYAAWVEIHKLPNLTVDQMAAFITKLFDDPSQSSELLSEAKKLNDSQAPK

SEQ ID NO: 878 - protein, 58 aa, ARTIFICIAL SEQUENCE
  Engineered IL6 binding polypeptide
VDAKYAKEEAYAWKEIHKLPNLTIEQMAAFITKLFDDPSQSSELLSEAKKLNDSQAPK

SEQ ID NO: 879 - protein, 58 aa, ARTIFICIAL SEQUENCE
  Engineered IL6 binding polypeptide
VDAKYAKEEKAAWTEIHLLPNLTIFQMAAFISKLFDDPSQSSELLSEAKKLNDSQAPK

SEQ ID NO: 880 - protein, 58 aa, ARTIFICIAL SEQUENCE
  Engineered IL6 binding polypeptide
VDAKYAKEEKEAWYEIHLLPNLTITQMAAFITKLFDDPSQSSELLSEAKKLNDSQAPK

SEQ ID NO: 881 - protein, 58 aa, ARTIFICIAL SEQUENCE
  Engineered IL6 binding polypeptide
VDAKYAKEERKAWYEIHLLPNLTVTQMAAFISKLFDDPSQSSELLSEAKKLNDSQAPK

SEQ ID NO: 882 - protein, 58 aa, ARTIFICIAL SEQUENCE
  Engineered IL6 binding polypeptide
VDAKYAKEEAMAWREIHLLPNLTVNQIAAFITKLFDDPSQSSELLSEAKKLNDSQAPK

SEQ ID NO: 883 - protein, 58 aa, ARTIFICIAL SEQUENCE
  Engineered IL6 binding polypeptide
VDAKYAKEEKHAWNEIHKLPNLTVEQMAAFITKLFDDPSQSSELLSEAKKLNDSQAPK

SEQ ID NO: 884 - protein, 58 aa, ARTIFICIAL SEQUENCE
  Engineered IL6 binding polypeptide
VDAKYAKEEYEAWTEIHKLPNLTIDQMAAFITKLFDDPSQSSELLSEAKKLNDSQAPK

SEQ ID NO: 885 - protein, 58 aa, ARTIFICIAL SEQUENCE
  Engineered IL6 binding polypeptide
VDAKYAKEEWNAWTEIHNLPNLTIDQMAAFITKLFDDPSQSSELLSEAKKLNDSQAPK

SEQ ID NO: 886 - protein, 58 aa, ARTIFICIAL SEQUENCE
  Engineered IL6 binding polypeptide
VDAKYAKEERAAWTEIHGLPNLTVEQMAAFITKLFDDPSQSSELLSEAKKLNDSQAPK

SEQ ID NO: 887 - protein, 58 aa, ARTIFICIAL SEQUENCE
  Engineered IL6 binding polypeptide
VDAKYAKEEADAWLEIHNLPNLTISQMAAFITKLFDDPSQSSELLSEAKKLNDSQAPK

SEQ ID NO: 888 - protein, 58 aa, ARTIFICIAL SEQUENCE
  Engineered IL6 binding polypeptide
VDAKYAKEEKAAWHEIHILPNLTVYQIAAFITKLFDDPSQSSELLSEAKKLNDSQAPK

SEQ ID NO: 889 - protein, 58 aa, ARTIFICIAL SEQUENCE
  Engineered IL6 binding polypeptide
VDAKYAKEEEKAWWEIHILPNLTIEQMAAFISKLFDDPSQSSELLSEAKKLNDSQAPK

SEQ ID NO: 890 - protein, 58 aa, ARTIFICIAL SEQUENCE
  Engineered IL6 binding polypeptide
VDAKYAKEEKSAWMEIHLLPNLTIEQMAAFITKLFDDPSQSSELLSEAKKLNDSQAPK

SEQ ID NO: 891 - protein, 58 aa, ARTIFICIAL SEQUENCE
  Engineered IL6 binding polypeptide
VDAKYAKEEYAAWMEIHRLPNLTIEQIAAFITKLFDDPSQSSELLSEAKKLNDSQAPK

SEQ ID NO: 892 - protein, 58 aa, ARTIFICIAL SEQUENCE
  Engineered IL6 binding polypeptide
VDAKYAKEEFRAWIEIHTLPNLTVDQMAAFITKLFDDPSQSSELLSEAKKLNDSQAPK

SEQ ID NO: 893 - protein, 58 aa, ARTIFICIAL SEQUENCE
  Engineered IL6 binding polypeptide
VDAKYAKEEKDAWNEIHKLPNLTIEQIAAFITKLFDDPSQSSELLSEAKKLNDSQAPK

SEQ ID NO: 894 - protein, 58 aa, ARTIFICIAL SEQUENCE
  Engineered IL6 binding polypeptide
VDAKYAKEEKHAWYEIHLLPNLTVEQMAAFITKLFDDPSQSSELLSEAKKLNDSQAPK

SEQ ID NO: 895 - protein, 58 aa, ARTIFICIAL SEQUENCE
  Engineered IL6 binding polypeptide
VDAKYAKEEYEAWLEIHLLPNLTVDQMAAFISKLFDDPSQSSELLSEAKKLNDSQAPK

SEQ ID NO: 896 - protein, 58 aa, ARTIFICIAL SEQUENCE
  Engineered IL6 binding polypeptide
VDAKYAKEEKNAWHEIHRLPNLTVNQMAAFITKLFDDPSQSSELLSEAKKLNDSQAPK

SEQ ID NO: 897 - protein, 58 aa, ARTIFICIAL SEQUENCE
  Engineered IL6 binding polypeptide
VDAKYAKEEKNAWTEIHNLPNLTISQMAAFITKLFDDPSQSSELLSEAKKLNDSQAPK

SEQ ID NO: 898 - protein, 58 aa, ARTIFICIAL SEQUENCE
  Engineered IL6 binding polypeptide
VDAKYAKEEAAAWYEIHALPNLTVEQMAAFITKLFDDPSQSSELLSEAKKLNDSQAPK

SEQ ID NO: 899 - protein, 58 aa, ARTIFICIAL SEQUENCE
  Engineered IL6 binding polypeptide
VDAKYAKEEWNAWMEIHLLPNLTVTQMAAFITKLFDDPSQSSELLSEAKKLNDSQAPK

SEQ ID NO: 900 - protein, 58 aa, ARTIFICIAL SEQUENCE
  Engineered IL6 binding polypeptide
VDAKYAKEEAKAWHEIHILPNLTVHQIAAFITKLFDDPSQSSELLSEAKKLNDSQAPK

SEQ ID NO: 901 - protein, 58 aa, ARTIFICIAL SEQUENCE
  Engineered IL6 binding polypeptide
VDAKYAKEERKAWHEIHILPNLTVHQIAAFITKLFDDPSQSSELLSEAKKLNDSQAPK

SEQ ID NO: 902 - protein, 58 aa, ARTIFICIAL SEQUENCE
  Engineered IL6 binding polypeptide
VDAKYAKEESKAWFEIHALPNLTVEQIAAFITKLFDDPSQSSELLSEAKKLNDSQAPK

SEQ ID NO: 903 - protein, 58 aa, ARTIFICIAL SEQUENCE
  Engineered IL6 binding polypeptide
VDAKYAKEEKRAWYEIHILPNLTISQIAAFITKLFDDPSQSSELLSEAKKLNDSQAPK

SEQ ID NO: 904 - protein, 58 aa, ARTIFICIAL SEQUENCE
  Engineered IL6 binding polypeptide
VDAKYAKEEKKAWTEIHVLPNLTISQIAAFISKLFDDPSQSSELLSEAKKLNDSQAPK

SEQ ID NO: 905 - protein, 58 aa, ARTIFICIAL SEQUENCE
  Engineered IL6 binding polypeptide
VDAKYAKEERDAWFEIHALPNLTIDQMAAFITKLFDDPSQSSELLSEAKKLNDSQAPK

SEQ ID NO: 906 - protein, 58 aa, ARTIFICIAL SEQUENCE
  Engineered IL6 binding polypeptide
VDAKYAKEEYEAWEEIHRLPNLTIDQMAAFISKLFDDPSQSSELLSEAKKLNDSQAPK

SEQ ID NO: 907 - protein, 58 aa, ARTIFICIAL SEQUENCE
  Engineered IL6 binding polypeptide
VDAKYAKEERNAWFEIHKLPNLTINQMAAFISKLFDDPSQSSELLSEAKKLNDSQAPK

SEQ ID NO: 908 - protein, 58 aa, ARTIFICIAL SEQUENCE
  Engineered IL6 binding polypeptide
VDAKYAKEEHHAWNEIHKLPNLTVDQIAAFISKLFDDPSQSSELLSEAKKLNDSQAPK

SEQ ID NO: 909 - protein, 58 aa, ARTIFICIAL SEQUENCE
  Engineered IL6 binding polypeptide
VDAKYAKEEHYAWKEIHLLPNLTIDQMAAFITKLFDDPSQSSELLSEAKKLNDSQAPK

SEQ ID NO: 910 - protein, 58 aa, ARTIFICIAL SEQUENCE
  Engineered IL6 binding polypeptide
VDAKYAKEESDAWYEIHLLPNLTIEQMAAFITKLFDDPSQSSELLSEAKKLNDSQAPK

SEQ ID NO: 911 - protein, 58 aa, ARTIFICIAL SEQUENCE
  Engineered IL6 binding polypeptide
VDAKYAKEEYEAWMEIHLLPNLTIGQMAAFITKLFDDPSQSSELLSEAKKLNDSQAPK

SEQ ID NO: 912 - protein, 58 aa, ARTIFICIAL SEQUENCE
  Engineered IL6 binding polypeptide
VDAKYAKEEKEAWYEIHLLPNLTVEQMAAFISKLFDDPSQSSELLSEAKKLNDSQAPK

SEQ ID NO: 913 - protein, 58 aa, ARTIFICIAL SEQUENCE
  Engineered IL6 binding polypeptide
VDAKYAKEERAAWKEIHILPNLTVEQIAAFITKLFDDPSQSSELLSEAKKLNDSQAPK

SEQ ID NO: 914 - protein, 58 aa, ARTIFICIAL SEQUENCE
  Engineered IL6 binding polypeptide
VDAKYAKEEKEAWYEIHILPNLTVHQMAAFITKLFDDPSQSSELLSEAKKLNDSQAPK

SEQ ID NO: 915 - protein, 58 aa, ARTIFICIAL SEQUENCE
  Engineered IL6 binding polypeptide
VDAKYAKEEYDAWIEIHALPNLTVDQMAAFISKLFDDPSQSSELLSEAKKLNDSQAPK

SEQ ID NO: 916 - protein, 58 aa, ARTIFICIAL SEQUENCE
  Engineered IL6 binding polypeptide
VDAKYAKEERKAWTEIHLLPNLTIDQMAAFITKLFDDPSQSSELLSEAKKLNDSQAPK

SEQ ID NO: 917 - protein, 58 aa, ARTIFICIAL SEQUENCE
  Engineered IL6 binding polypeptide
VDAKYAKEEYHAWVEIHNLPNLTIDQIAAFITKLFDDPSQSSELLSEAKKLNDSQAPK

SEQ ID NO: 918 - protein, 58 aa, ARTIFICIAL SEQUENCE
  Engineered IL6 binding polypeptide
VDAKYAKEEREAWTEIHKLPNLTIDQMAAFITKLFDDPSQSSELLSEAKKLNDSQAPK

SEQ ID NO: 919 - protein, 58 aa, ARTIFICIAL SEQUENCE
  Engineered IL6 binding polypeptide
VDAKYAKEEQWAWYEIHLLPNLTVNQMAAFITKLFDDPSQSSELLSEAKKLNDSQAPK

SEQ ID NO: 920 - protein, 58 aa, ARTIFICIAL SEQUENCE
  Engineered IL6 binding polypeptide
VDAKYAKEEKQAWMEIHKLPNLTVHQVAAFISKLFDDPSQSSELLSEAKKLNDSQAPK

SEQ ID NO: 921 - protein, 58 aa, ARTIFICIAL SEQUENCE
  Engineered IL6 binding polypeptide
VDAKYAKEESDAWTEIHKLPNLTIDQMAAFITKLFDDPSQSSELLSEAKKLNDSQAPK

SEQ ID NO: 922 - protein, 58 aa, ARTIFICIAL SEQUENCE
  Engineered IL6 binding polypeptide
VDAKYAKEEAQAWWEIHSLPNLTVDQIAAFITKLFDDPSQSSELLSEAKKLNDSQAPK

SEQ ID NO: 923 - protein, 58 aa, ARTIFICIAL SEQUENCE
  Engineered IL6 binding polypeptide
VDAKYAKEEKMAWYEIHNLPNLTVNQMAAFITKLFDDPSQSSELLSEAKKLNDSQAPK

SEQ ID NO: 924 - protein, 58 aa, ARTIFICIAL SEQUENCE
  Engineered IL6 binding polypeptide
VDAKYAKEEWMAWMEIHNLPNLTVNQMAAFITKLFDDPSQSSELLSEAKKLNDSQAPK

SEQ ID NO: 925 - protein, 58 aa, ARTIFICIAL SEQUENCE
  Engineered IL6 binding polypeptide
VDAKYAKEEARAWYEIHILPNLTVKQMAAFITKLFDDPSQSSELLSEAKKLNDSQAPK

SEQ ID NO: 926 - protein, 58 aa, ARTIFICIAL SEQUENCE
  Engineered IL6 binding polypeptide
VDAKYAKEEAKAWHEIHILPNLTVSQVAAFITKLFDDPSQSSELLSEAKKLNDSQAPK

SEQ ID NO: 927 - protein, 58 aa, ARTIFICIAL SEQUENCE
  Engineered IL6 binding polypeptide
VDAKYAKEERAAWHEIHILPNLTVDQMAAFISKLFDDPSQSSELLSEAKKLNDSQAPK

SEQ ID NO: 928 - protein, 58 aa, ARTIFICIAL SEQUENCE
  Engineered IL6 binding polypeptide
VDAKYAKEEWQAWTEIHLLPNLTLDQVAAFITKLFDDPSQSSELLSEAKKLNDSQAPK

SEQ ID NO: 929 - protein, 58 aa, ARTIFICIAL SEQUENCE
  Engineered IL6 binding polypeptide
VDAKYAKEEAFAWEEIHRLPNLTIEQMAAFISKLFDDPSQSSELLSEAKKLNDSQAPK

SEQ ID NO: 930 - protein, 58 aa, ARTIFICIAL SEQUENCE
  Engineered IL6 binding polypeptide
VDAKYAKEERKAWYEIHKLPNLTVDQMAAFITKLFDDPSQSSELLSEAKKLNDSQAPK

SEQ ID NO: 931 - protein, 58 aa, ARTIFICIAL SEQUENCE
  Engineered IL6 binding polypeptide
VDAKYAKEEKQAWYEIHLLPNLTVEQMAAFITKLFDDPSQSSELLSEAKKLNDSQAPK

SEQ ID NO: 932 - protein, 58 aa, ARTIFICIAL SEQUENCE
  Engineered IL6 binding polypeptide
VDAKYAKEEYDAWWEIHLLPNLTVDQMAAFITKLFDDPSQSSELLSEAKKLNDSQAPK

SEQ ID NO: 933 - protein, 58 aa, ARTIFICIAL SEQUENCE
  Engineered IL6 binding polypeptide
VDAKYAKEEHDAWNEIHLLPNLTIDQMAAFITKLFDDPSQSSELLSEAKKLNDSQAPK

SEQ ID NO: 934 - protein, 58 aa, ARTIFICIAL SEQUENCE
  Engineered IL6 binding polypeptide
VDAKYAKEEYTAWTEIHQLPNLTVQQMAAFITKLFDDPSQSSELLSEAKKLNDSQAPK

SEQ ID NO: 935 - protein, 58 aa, ARTIFICIAL SEQUENCE
  Engineered IL6 binding polypeptide
VDAKYAKEEARAWHEIHILPNLTVRQIAAFITKLFDDPSQSSELLSEAKKLNDSQAPK

SEQ ID NO: 936 - protein, 58 aa, ARTIFICIAL SEQUENCE
  Engineered IL6 binding polypeptide
VDAKYAKEERNAWFEIHQLPNLTVHQVAAFITKLFDDPSQSSELLSEAKKLNDSQAPK

SEQ ID NO: 937 - protein, 58 aa, ARTIFICIAL SEQUENCE
  Engineered IL6 binding polypeptide
VDAKYAKEEADAWYEIHLLPNLTVEQMAAFITKLFDDPSQSSELLSEAKKLNDSQAPK

SEQ ID NO: 938 - protein, 58 aa, ARTIFICIAL SEQUENCE
  Engineered IL6 binding polypeptide
VDAKYAKEEFEAWKEIHILPNLTVDQMAAFITKLFDDPSQSSELLSEAKKLNDSQAPK

SEQ ID NO: 939 - protein, 58 aa, ARTIFICIAL SEQUENCE
  Engineered IL6 binding polypeptide
VDAKYAKEEAYAWWEIHKLPNLTVHQMAAFITKLFDDPSQSSELLSEAKKLNDSQAPK

SEQ ID NO: 940 - protein, 58 aa, ARTIFICIAL SEQUENCE
  Engineered IL6 binding polypeptide
VDAKYAKEEKTAWHEIHNLPNLTIDQMAAFITKLFDDPSQSSELLSEAKKLNDSQAPK

SEQ ID NO: 941 - protein, 58 aa, ARTIFICIAL SEQUENCE
  Engineered IL6 binding polypeptide
VDAKYAKEEAKAWNEIHKLPNLTIDQIAAFISKLFDDPSQSSELLSEAKKLNDSQAPK

SEQ ID NO: 942 - protein, 58 aa, ARTIFICIAL SEQUENCE
  Engineered IL6 binding polypeptide
VDAKYAKEEKDAWIEIHNLPNLTVEQMAAFITKLFDDPSQSSELLSEAKKLNDSQAPK

SEQ ID NO: 943 - protein, 58 aa, ARTIFICIAL SEQUENCE
  Engineered IL6 binding polypeptide
VDAKYAKEEFFAWKEIHLLPNLTVEQIAAFITKLFDDPSQSSELLSEAKKLNDSQAPK

SEQ ID NO: 944 - protein, 58 aa, ARTIFICIAL SEQUENCE
  Engineered IL6 binding polypeptide
VDAKYAKEEQAAWLEIHLLPNLTVSQIAAFITKLFDDPSQSSELLSEAKKLNDSQAPK

SEQ ID NO: 945 - protein, 58 aa, ARTIFICIAL SEQUENCE
  Engineered IL6 binding polypeptide
VDAKYAKEEYFAWREIHVLPNLTVDQMAAFISKLFDDPSQSSELLSEAKKLNDSQAPK

SEQ ID NO: 946 - protein, 58 aa, ARTIFICIAL SEQUENCE
  Engineered IL6 binding polypeptide
VDAKYAKEEYYAWREIHLLPNLTITQMAAFITKLFDDPSQSSELLSEAKKLNDSQAPK

SEQ ID NO: 947 - protein, 58 aa, ARTIFICIAL SEQUENCE
  Engineered IL6 binding polypeptide
VDAKYAKEEKMAWTEIHLLPNLTISQMAAFITKLFDDPSQSSELLSEAKKLNDSQAPK

SEQ ID NO: 948 - protein, 58 aa, ARTIFICIAL SEQUENCE
  Engineered IL6 binding polypeptide
VDAKYAKEERNAWFEIHVLPNLTVKQMAAFITKLFDDPSQSSELLSEAKKLNDSQAPK

SEQ ID NO: 949 - protein, 58 aa, ARTIFICIAL SEQUENCE
  Engineered IL6 binding polypeptide
VDAKYAKEEKRAWTEIHILPNLTVEQMAAFISKLFDDPSQSSELLSEAKKLNDSQAPK

SEQ ID NO: 950 - protein, 58 aa, ARTIFICIAL SEQUENCE
  Engineered IL6 binding polypeptide
VDAKYAKEEAAAWKEIHLLPNLTIDQMAAFITKLFDDPSQSSELLSEAKKLNDSQAPK

SEQ ID NO: 951 - protein, 58 aa, ARTIFICIAL SEQUENCE
  Engineered IL6 binding polypeptide
VDAKYAKEEKEAWMEIHALPNLTVDQVAAFITKLFDDPSQSSELLSEAKKLNDSQAPK

SEQ ID NO: 952 - protein, 58 aa, ARTIFICIAL SEQUENCE
  Engineered IL6 binding polypeptide
VDAKYAKEEKEAWYEIHNLPNLTIIQMAAFISKLFDDPSQSSELLSEAKKLNDSQAPK

SEQ ID NO: 953 - protein, 58 aa, ARTIFICIAL SEQUENCE
  Engineered IL6 binding polypeptide
VDAKYAKEEYDAWFEIHILPNLTVHQIAAFITKLFDDPSQSSELLSEAKKLNDSQAPK

SEQ ID NO: 954 - protein, 58 aa, ARTIFICIAL SEQUENCE
  Engineered IL6 binding polypeptide
VDAKYAKEEYGAWNEIHKLPNLTIDQMAAFITKLFDDPSQSSELLSEAKKLNDSQAPK

SEQ ID NO: 955 - protein, 58 aa, ARTIFICIAL SEQUENCE
  Engineered IL6 binding polypeptide
VDAKYAKEEWQAWMEIHSLPNLTVDQMAAFITKLFDDPSQSSELLSEAKKLNDSQAPK

SEQ ID NO: 956 - protein, 58 aa, ARTIFICIAL SEQUENCE
  Engineered IL6 binding polypeptide
VDAKYAKEEWNAWFEIHKLPNLTVEQMAAFITKLFDDPSQSSELLSEAKKLNDSQAPK

SEQ ID NO: 957 - protein, 58 aa, ARTIFICIAL SEQUENCE
  Engineered IL6 binding polypeptide
VDAKYAKEEANAWKEIHLLPNLTVDQMAAFITKLFDDPSQSSELLSEAKKLNDSQAPK

SEQ ID NO: 958 - protein, 58 aa, ARTIFICIAL SEQUENCE
  Engineered IL6 binding polypeptide
VDAKYAKEEYEAWTEIHLLPNLTVHQMAAFITKLFDDPSQSSELLSEAKKLNDSQAPK

SEQ ID NO: 959 - protein, 58 aa, ARTIFICIAL SEQUENCE
  Engineered IL6 binding polypeptide
VDAKYAKEERIAWWEIHSLPNLTVNQVAAFISKLFDDPSQSSELLSEAKKLNDSQAPK

SEQ ID NO: 960 - protein, 58 aa, ARTIFICIAL SEQUENCE
  Engineered IL6 binding polypeptide
VDAKYAKEEYNAWVEIHTLPNLTVNQMAAFITKLFDDPSQSSELLSEAKKLNDSQAPK

SEQ ID NO: 961 - protein, 58 aa, ARTIFICIAL SEQUENCE
  Engineered IL6 binding polypeptide
VDAKYAKEEAFAWSEIHILPNLTIDQIAAFITKLFDDPSQSSELLSEAKKLNDSQAPK

SEQ ID NO: 962 - protein, 58 aa, ARTIFICIAL SEQUENCE
  Engineered IL6 binding polypeptide
VDAKYAKEEAHAWHEIHILPNLTIDQMAAFISKLFDDPSQSSELLSEAKKLNDSQAPK

SEQ ID NO: 963 - protein, 58 aa, ARTIFICIAL SEQUENCE
  Engineered IL6 binding polypeptide
VDAKYAKEEAAAWNEIHRLPNLTVDQIAAFISKLFDDPSQSSELLSEAKKLNDSQAPK

SEQ ID NO: 964 - protein, 58 aa, ARTIFICIAL SEQUENCE
  Engineered IL6 binding polypeptide
VDAKYAKEEKAAWTEIHLLPNLTVDQMAAFITKLFDDPSQSSELLSEAKKLNDSQAPK

SEQ ID NO: 965 - protein, 58 aa, ARTIFICIAL SEQUENCE
  Engineered IL6 binding polypeptide
VDAKYAKEEKGAWNEIHLLPNLTIQQMAAFISKLFDDPSQSSELLSEAKKLNDSQAPK

SEQ ID NO: 966 - protein, 58 aa, ARTIFICIAL SEQUENCE
  Engineered IL6 binding polypeptide
VDAKYAKEEYAAWMEIHSLPNLTVDQMAAFITKLFDDPSQSSELLSEAKKLNDSQAPK

SEQ ID NO: 967 - protein, 58 aa, ARTIFICIAL SEQUENCE
  Engineered IL6 binding polypeptide
VDAKYAKEEAAAWKEIHILPNLTIEQIAAFISKLFDDPSQSSELLSEAKKLNDSQAPK

SEQ ID NO: 968 - protein, 58 aa, ARTIFICIAL SEQUENCE
  Engineered IL6 binding polypeptide
VDAKYAKEEKFAWNEIHILPNLTVHQIAAFITKLFDDPSQSSELLSEAKKLNDSQAPK

SEQ ID NO: 969 - protein, 58 aa, ARTIFICIAL SEQUENCE
  Engineered IL6 binding polypeptide
VDAKYAKEEYNAWLEIHKLPNLTINQMAAFITKLFDDPSQSSELLSEAKKLNDSQAPK

SEQ ID NO: 970 - protein, 58 aa, ARTIFICIAL SEQUENCE
  Engineered IL6 binding polypeptide
VDAKYAKEEHTAWLEIHSLPNLTIEQVAAFITKLFDDPSQSSELLSEAKKLNDSQAPK

SEQ ID NO: 971 - protein, 58 aa, ARTIFICIAL SEQUENCE
  Engineered IL6 binding polypeptide
VDAKYAKEEKDAWMEIHILPNLTVDQMAAFITKLFDDPSQSSELLSEAKKLNDSQAPK

SEQ ID NO: 972 - protein, 58 aa, ARTIFICIAL SEQUENCE
  Engineered IL6 binding polypeptide
VDAKYAKEEATAWIEIHSLPNLTVDQMAAFITKLFDDPSQSSELLSEAKKLNDSQAPK

SEQ ID NO: 973 - protein, 58 aa, ARTIFICIAL SEQUENCE
  Engineered IL6 binding polypeptide
VDAKYAKEEKEAWWEIHLLPNLTVDQMAAFITKLFDDPSQSSELLSEAKKLNDSQAPK

SEQ ID NO: 974 - protein, 58 aa, ARTIFICIAL SEQUENCE
  Engineered IL6 binding polypeptide
VDAKYAKEEQHAWIEIHKLPNLTVDQMAAFITKLFDDPSQSSELLSEAKKLNDSQAPK

SEQ ID NO: 975 - protein, 58 aa, ARTIFICIAL SEQUENCE
  Engineered IL6 binding polypeptide
VDAKYAKEEKHAWHEIHILPNLTIEQMAAFISKLFDDPSQSSELLSEAKKLNDSQAPK

SEQ ID NO: 976 - protein, 58 aa, ARTIFICIAL SEQUENCE
  Engineered IL6 binding polypeptide
VDAKYAKEEAKAWHEIHILPNLTIEQMAAFITKLFDDPSQSSELLSEAKKLNDSQAPK

SEQ ID NO: 977 - protein, 58 aa, ARTIFICIAL SEQUENCE
  Engineered IL6 binding polypeptide
VDAKYAKEEKKAWTEIHILPNLTVEQIAAFITKLFDDPSQSSELLSEAKKLNDSQAPK

SEQ ID NO: 978 - protein, 58 aa, ARTIFICIAL SEQUENCE
  Engineered IL6 binding polypeptide
VDAKYAKEERAAWYEIHVLPNLTVSQMAAFISKLFDDPSQSSELLSEAKKLNDSQAPK

SEQ ID NO: 979 - protein, 58 aa, ARTIFICIAL SEQUENCE
  Engineered IL6 binding polypeptide
VDAKYAKEERFAWAEIHKLPNLTIDQMAAFITKLFDDPSQSSELLSEAKKLNDSQAPK

SEQ ID NO: 980 - protein, 58 aa, ARTIFICIAL SEQUENCE
  Engineered IL6 binding polypeptide
VDAKYAKEEYAAWFEIHLLPNLTIDQMAAFISKLFDDPSQSSELLSEAKKLNDSQAPK

SEQ ID NO: 981 - protein, 58 aa, ARTIFICIAL SEQUENCE
  Engineered IL6 binding polypeptide
VDAKYAKEEYDAWFEIHLLPNLTIDQMAAFISKLFDDPSQSSELLSEAKKLNDSQAPK

SEQ ID NO: 982 - protein, 58 aa, ARTIFICIAL SEQUENCE
  Engineered IL6 binding polypeptide
VDAKYAKEEWEAWMEIHALPNLTVDQMAAFITKLFDDPSQSSELLSEAKKLNDSQAPK

SEQ ID NO: 983 - protein, 58 aa, ARTIFICIAL SEQUENCE
  Engineered IL6 binding polypeptide
VDAKYAKEEKDAWWEIHALPNLTIEQMAAFITKLFDDPSQSSELLSEAKKLNDSQAPK

SEQ ID NO: 984 - protein, 58 aa, ARTIFICIAL SEQUENCE
  Engineered IL6 binding polypeptide
VDAKYAKEERDAWFEIHSLPNLTVDQMAAFITKLFDDPSQSSELLSEAKKLNDSQAPK

SEQ ID NO: 985 - protein, 58 aa, ARTIFICIAL SEQUENCE
  Engineered IL6 binding polypeptide
VDAKYAKEEFYAWLEIHKLPNLTVSQMAAFITKLFDDPSQSSELLSEAKKLNDSQAPK

SEQ ID NO: 986 - protein, 58 aa, ARTIFICIAL SEQUENCE
  Engineered IL6 binding polypeptide
VDAKYAKEEYEAWYEIHILPNLTVDQMAAFITKLFDDPSQSSELLSEAKKLNDSQAPK

SEQ ID NO: 987 - protein, 58 aa, ARTIFICIAL SEQUENCE
  Engineered IL6 binding polypeptide
VDAKYAKEERDAWFEIHLLPNLTVNQMAAFITKLFDDPSQSSELLSEAKKLNDSQAPK

SEQ ID NO: 988 - protein, 58 aa, ARTIFICIAL SEQUENCE
  Engineered IL6 binding polypeptide
VDAKYAKEEYRAWTEIHILPNLTITQIAAFITKLFDDPSQSSELLSEAKKLNDSQAPK

SEQ ID NO: 989 - protein, 58 aa, ARTIFICIAL SEQUENCE
  Engineered IL6 binding polypeptide
VDAKYAKEEYEAWTEIHLLPNLTIEQMAAFISKLFDDPSQSSELLSEAKKLNDSQAPK

SEQ ID NO: 990 - protein, 58 aa, ARTIFICIAL SEQUENCE
  Engineered IL6 binding polypeptide
VDAKYAKEEYDAWLEIHILPNLTVEQIAAFITKLFDDPSQSSELLSEAKKLNDSQAPK

SEQ ID NO: 991 - protein, 58 aa, ARTIFICIAL SEQUENCE
  Engineered IL6 binding polypeptide
VDAKYAKEERKAWYEIHSLPNLTVDQMAAFITKLFDDPSQSSELLSEAKKLNDSQAPK

SEQ ID NO: 992 - protein, 58 aa, ARTIFICIAL SEQUENCE
  Engineered IL6 binding polypeptide
VDAKYAKEEHTAWTEIHRLPNLTIEQMAAFITKLFDDPSQSSELLSEAKKLNDSQAPK

SEQ ID NO: 993 - protein, 58 aa, ARTIFICIAL SEQUENCE
  Engineered IL6 binding polypeptide
VDAKYAKEEYQAWTEIHLLPNLTVEQMAAFITKLFDDPSQSSELLSEAKKLNDSQAPK

SEQ ID NO: 994 - protein, 58 aa, ARTIFICIAL SEQUENCE
  Engineered IL6 binding polypeptide
VDAKYAKEERMAWFEIHSLPNLTVDQMAAFITKLFDDPSQSSELLSEAKKLNDSQAPK

SEQ ID NO: 995 - protein, 58 aa, ARTIFICIAL SEQUENCE
  Engineered IL6 binding polypeptide
VDAKYAKEEYDAWYEIHILPNLTVEQIAAFITKLFDDPSQSSELLSEAKKLNDSQAPK

SEQ ID NO: 996 - protein, 58 aa, ARTIFICIAL SEQUENCE
  Engineered IL6 binding polypeptide
VDAKYAKEEKEAWMEIHLLPNLTIDQMAAFITKLFDDPSQSSELLSEAKKLNDSQAPK

SEQ ID NO: 997 - protein, 58 aa, ARTIFICIAL SEQUENCE
  Engineered IL6 binding polypeptide
VDAKYAKEEYDAWFEIHSLPNLTVNQMAAFITKLFDDPSQSSELLSEAKKLNDSQAPK

SEQ ID NO: 998 - protein, 58 aa, ARTIFICIAL SEQUENCE
  Engineered IL6 binding polypeptide
VDAKYAKEEAFAWREIHILPNLTIDQMAAFITKLFDDPSQSSELLSEAKKLNDSQAPK

SEQ ID NO: 999 - protein, 58 aa, ARTIFICIAL SEQUENCE
  Engineered IL6 binding polypeptide
VDAKYAKEERKAWMEIHLLPNLTIEQMAAFITKLFDDPSQSSELLSEAKKLNDSQAPK

SEQ ID NO: 1000 - protein, 58 aa, ARTIFICIAL SEQUENCE
  Engineered IL6 binding polypeptide
VDAKYAKEEKAAWIEIHNLPNLTVDQMAAFITKLFDDPSQSSELLSEAKKLNDSQAPK

SEQ ID NO: 1001 - protein, 58 aa, ARTIFICIAL SEQUENCE
  Engineered IL6 binding polypeptide
VDAKYAKEERNAWIEIHNLPNLTIEQMAAFITKLFDDPSQSSELLSEAKKLNDSQAPK

SEQ ID NO: 1002 - protein, 58 aa, ARTIFICIAL SEQUENCE
  Engineered IL6 binding polypeptide
VDAKYAKEEKNAWTEIHLLPNLTIEQMAAFITKLFDDPSQSSELLSEAKKLNDSQAPK

SEQ ID NO: 1003 - protein, 58 aa, ARTIFICIAL SEQUENCE
  Engineered IL6 binding polypeptide
VDAKYAKEEAEAWWEIHILPNLTIDQMAAFITKLFDDPSQSSELLSEAKKLNDSQAPK

SEQ ID NO: 1004 - protein, 58 aa, ARTIFICIAL SEQUENCE
  Engineered IL6 binding polypeptide
VDAKYAKEEKLAWWEIHKLPNLTVDQMAAFITKLFDDPSQSSELLSEAKKLNDSQAPK

SEQ ID NO: 1005 - protein, 58 aa, ARTIFICIAL SEQUENCE
  Engineered IL6 binding polypeptide
VDAKYAKEEYEAWYEIHILPNLTIHQMAAFITKLFDDPSQSSELLSEAKKLNDSQAPK

SEQ ID NO: 1006 - protein, 58 aa, ARTIFICIAL SEQUENCE
  Engineered IL6 binding polypeptide
VDAKYAKEEARAWKEIHLLPNLTVGQIAAFITKLFDDPSQSSELLSEAKKLNDSQAPK

SEQ ID NO: 1007 - protein, 58 aa, ARTIFICIAL SEQUENCE
  Engineered IL6 binding polypeptide
VDAKYAKEEKQAWMEIHLLPNLTVDQMAAFITKLFDDPSQSSELLSEAKKLNDSQAPK

SEQ ID NO: 1008 - protein, 58 aa, ARTIFICIAL SEQUENCE
  Engineered IL6 binding polypeptide
VDAKYAKEEAAAWHEIHILPNLTVHQIAAFITKLFDDPSQSSELLSEAKKLNDSQAPK

SEQ ID NO: 1009 - protein, 58 aa, ARTIFICIAL SEQUENCE
  Engineered IL6 binding polypeptide
VDAKYAKEEKEAWFEIHKLPNLTVSQMAAFITKLFDDPSQSSELLSEAKKLNDSQAPK

SEQ ID NO: 1010 - protein, 58 aa, ARTIFICIAL SEQUENCE
  Engineered IL6 binding polypeptide
VDAKYAKEEKEAWFEIHTLPNLTVDQMAAFISKLFDDPSQSSELLSEAKKLNDSQAPK

SEQ ID NO: 1011 - protein, 58 aa, ARTIFICIAL SEQUENCE
  Engineered IL6 binding polypeptide
VDAKYAKEEYLAWVEIHNLPNLTIDQMAAFITKLFDDPSQSSELLSEAKKLNDSQAPK

SEQ ID NO: 1012 - protein, 58 aa, ARTIFICIAL SEQUENCE
  Engineered IL6 binding polypeptide
VDAKYAKEERDAWYEIHNLPNLTVGQMAAFITKLFDDPSQSSELLSEAKKLNDSQAPK

SEQ ID NO: 1013 - protein, 58 aa, ARTIFICIAL SEQUENCE
  Engineered IL6 binding polypeptide
VDAKYAKEESAAWFEIHLLPNLTINQMAAFITKLFDDPSQSSELLSEAKKLNDSQAPK

SEQ ID NO: 1014 - protein, 58 aa, ARTIFICIAL SEQUENCE
  Engineered IL6 binding polypeptide
VDAKYAKEEQYAWTEIHILPNLTVNQIAAFITKLFDDPSQSSELLSEAKKLNDSQAPK

SEQ ID NO: 1015 - protein, 58 aa, ARTIFICIAL SEQUENCE
  Engineered IL6 binding polypeptide
VDAKYAKEEKRAWMEIHLLPNLTVSQMAAFITKLFDDPSQSSELLSEAKKLNDSQAPK

SEQ ID NO: 1016 - protein, 58 aa, ARTIFICIAL SEQUENCE
  Engineered IL6 binding polypeptide
VDAKYAKEEKKAWFEIHLLPNLTIHQVAAFISKLFDDPSQSSELLSEAKKLNDSQAPK

SEQ ID NO: 1017 - protein, 58 aa, ARTIFICIAL SEQUENCE
  Engineered IL6 binding polypeptide
VDAKYAKEEKEAWYEIHSLPNLTVDQVAAFITKLFDDPSQSSELLSEAKKLNDSQAPK

SEQ ID NO: 1018 - protein, 58 aa, ARTIFICIAL SEQUENCE
  Engineered IL6 binding polypeptide
VDAKYAKEEWLAWNEIHLLPNLTISQIAAFISKLFDDPSQSSELLSEAKKLNDSQAPK

SEQ ID NO: 1019 - protein, 58 aa, ARTIFICIAL SEQUENCE
  Engineered IL6 binding polypeptide
VDAKYAKEEYNAWLEIHILPNLTVHQIAAFISKLFDDPSQSSELLSEAKKLNDSQAPK

SEQ ID NO: 1020 - protein, 58 aa, ARTIFICIAL SEQUENCE
  Engineered IL6 binding polypeptide
VDAKYAKEEHTAWMEIHRLPNLTIDQIAAFISKLFDDPSQSSELLSEAKKLNDSQAPK

SEQ ID NO: 1021 - protein, 58 aa, ARTIFICIAL SEQUENCE
  Engineered IL6 binding polypeptide
VDAKYAKEEKFAWTEIHLLPNLTVHQMAAFITKLFDDPSQSSELLSEAKKLNDSQAPK

SEQ ID NO: 1022 - protein, 58 aa, ARTIFICIAL SEQUENCE
  Engineered IL6 binding polypeptide
VDAKYAKEEKYAWTEIHILPNLTVNQMAAFITKLFDDPSQSSELLSEAKKLNDSQAPK

SEQ ID NO: 1023 - protein, 58 aa, ARTIFICIAL SEQUENCE
  Engineered IL6 binding polypeptide
VDAKYAKEEKFAWHEIHKLPNLTVDQIAAFITKLFDDPSQSSELLSEAKKLNDSQAPK

SEQ ID NO: 1024 - protein, 58 aa, ARTIFICIAL SEQUENCE
  Engineered IL6 binding polypeptide
VDAKYAKEERKAWYEIHGLPNLTVEQMAAFITKLFDDPSQSSELLSEAKKLNDSQAPK

SEQ ID NO: 1025 - protein, 58 aa, ARTIFICIAL SEQUENCE
  Engineered IL6 binding polypeptide
VDAKYAKEEYQAWLEIHLLPNLTVDQIAAFITKLFDDPSQSSELLSEAKKLNDSQAPK

SEQ ID NO: 1026 - protein, 58 aa, ARTIFICIAL SEQUENCE
  Engineered IL6 binding polypeptide
VDAKYAKEEKHAWMEIHLLPNLTVEQMAAFITKLFDDPSQSSELLSEAKKLNDSQAPK

SEQ ID NO: 1027 - protein, 58 aa, ARTIFICIAL SEQUENCE
  Engineered IL6 binding polypeptide
VDAKYAKEEKQAWREIHLLPNLTVDQIAAFISKLFDDPSQSSELLSEAKKLNDSQAPK

SEQ ID NO: 1028 - protein, 58 aa, ARTIFICIAL SEQUENCE
  Engineered IL6 binding polypeptide
VDAKYAKEEAMAWTEIHLLPNLTVSQMAAFITKLFDDPSQSSELLSEAKKLNDSQAPK

SEQ ID NO: 1029 - protein, 58 aa, ARTIFICIAL SEQUENCE
  Engineered IL6 binding polypeptide
VDAKYAKEEKHAWREIHLLPNLTLNQMAAFITKLFDDPSQSSELLSEAKKLNDSQAPK

SEQ ID NO: 1030 - protein, 58 aa, ARTIFICIAL SEQUENCE
  Engineered IL6 binding polypeptide
VDAKYAKEERYAWNEIHALPNLTVEQVAAFITKLFDDPSQSSELLSEAKKLNDSQAPK

SEQ ID NO: 1031 - protein, 58 aa, ARTIFICIAL SEQUENCE
  Engineered IL6 binding polypeptide
VDAKYAKEEREAWWEIHKLPNLTVDQMAAFISKLFDDPSQSSELLSEAKKLNDSQAPK

SEQ ID NO: 1032 - protein, 58 aa, ARTIFICIAL SEQUENCE
  Engineered IL6 binding polypeptide
VDAKYAKEEHRAWTEIHLLPNLTVDQMAAFISKLFDDPSQSSELLSEAKKLNDSQAPK

SEQ ID NO: 1033 - protein, 58 aa, ARTIFICIAL SEQUENCE
  Engineered IL6 binding polypeptide
VDAKYAKEEAYAWAEIHKLPNLTVVQMAAFISKLFDDPSQSSELLSEAKKLNDSQAPK

SEQ ID NO: 1034 - protein, 58 aa, ARTIFICIAL SEQUENCE
  Engineered IL6 binding polypeptide
VDAKYAKEEYFAWTEIHKLPNLTIDQIAAFITKLFDDPSQSSELLSEAKKLNDSQAPK

SEQ ID NO: 1035 - protein, 58 aa, ARTIFICIAL SEQUENCE
  Engineered IL6 binding polypeptide
VDAKYAKEEAHAWQEIHKLPNLTINQIAAFISKLFDDPSQSSELLSEAKKLNDSQAPK

SEQ ID NO: 1036 - protein, 58 aa, ARTIFICIAL SEQUENCE
  Engineered IL6 binding polypeptide
VDAKYAKEEKHAWTEIHKLPNLTIDQMAAFITKLFDDPSQSSELLSEAKKLNDSQAPK

SEQ ID NO: 1037 - protein, 58 aa, ARTIFICIAL SEQUENCE
  Engineered IL6 binding polypeptide
VDAKYAKEEYRAWYEIHILPNLTVKQMAAFITKLFDDPSQSSELLSEAKKLNDSQAPK

SEQ ID NO: 1038 - protein, 58 aa, ARTIFICIAL SEQUENCE
  Engineered IL6 binding polypeptide
VDAKYAKEEANAWIEIHKLPNLTVDQMAAFITKLFDDPSQSSELLSEAKKLNDSQAPK

SEQ ID NO: 1039 - protein, 58 aa, ARTIFICIAL SEQUENCE
  Engineered IL6 binding polypeptide
VDAKYAKEEKDAWTEIHKLPNLTIDQMAAFITKLFDDPSQSSELLSEAKKLNDSQAPK

SEQ ID NO: 1040 - protein, 58 aa, ARTIFICIAL SEQUENCE
  Engineered IL6 binding polypeptide
VDAKYAKEEREAWYEIHNLPNLTIIQMAAFISKLFDDPSQSSELLSEAKKLNDSQAPK

SEQ ID NO: 1041 - protein, 58 aa, ARTIFICIAL SEQUENCE
  Engineered IL6 binding polypeptide
VDAKYAKEEYYAWNEIHLLPNLTIEQMAAFITKLFDDPSQSSELLSEAKKLNDSQAPK

SEQ ID NO: 1042 - protein, 58 aa, ARTIFICIAL SEQUENCE
  Engineered IL6 binding polypeptide
VDAKYAKEEKTAWREIHLLPNLTIDQIAAFITKLFDDPSQSSELLSEAKKLNDSQAPK

SEQ ID NO: 1043 - protein, 58 aa, ARTIFICIAL SEQUENCE
  Engineered IL6 binding polypeptide
VDAKYAKEEAHAWREIHILPNLTLDQMAAFITKLFDDPSQSSELLSEAKKLNDSQAPK

SEQ ID NO: 1044 - protein, 58 aa, ARTIFICIAL SEQUENCE
  Engineered IL6 binding polypeptide
VDAKYAKEEAAAWLEIHQLPNLTVDQMAAFITKLFDDPSQSSELLSEAKKLNDSQAPK

SEQ ID NO: 1045 - protein, 58 aa, ARTIFICIAL SEQUENCE
  Engineered IL6 binding polypeptide
VDAKYAKEEAEAWLEIHILPNLTVEQMAAFITKLFDDPSQSSELLSEAKKLNDSQAPK

SEQ ID NO: 1046 - protein, 58 aa, ARTIFICIAL SEQUENCE
  Engineered IL6 binding polypeptide
VDAKYAKEEANAWFEIHILPNLTVQQMAAFITKLFDDPSQSSELLSEAKKLNDSQAPK

SEQ ID NO: 1047 - protein, 58 aa, ARTIFICIAL SEQUENCE
  Engineered IL6 binding polypeptide
VDAKYAKEERYAWMEIHLLPNLTINQMAAFITKLFDDPSQSSELLSEAKKLNDSQAPK

SEQ ID NO: 1048 - protein, 58 aa, ARTIFICIAL SEQUENCE
  Engineered IL6 binding polypeptide
VDAKYAKEERFAWNEIHKLPNLTIDQMAAFITKLFDDPSQSSELLSEAKKLNDSQAPK

SEQ ID NO: 1049 - protein, 58 aa, ARTIFICIAL SEQUENCE
  Engineered IL6 binding polypeptide
VDAKYAKEEAKAWFEIHLLPNLTIQQIAAFITKLFDDPSQSSELLSEAKKLNDSQAPK

SEQ ID NO: 1050 - protein, 58 aa, ARTIFICIAL SEQUENCE
  Engineered IL6 binding polypeptide
VDAKYAKEEREAWTEIHILPNLTIDQMAAFITKLFDDPSQSSELLSEAKKLNDSQAPK

SEQ ID NO: 1051 - protein, 58 aa, ARTIFICIAL SEQUENCE
  Engineered IL6 binding polypeptide
VDAKYAKEEFEAWNEIHKLPNLTIEQMAAFISKLFDDPSQSSELLSEAKKLNDSQAPK

SEQ ID NO: 1052 - protein, 58 aa, ARTIFICIAL SEQUENCE
  Engineered IL6 binding polypeptide
VDAKYAKEEKEAWYEIHILPNLTVHQIAAFISKLFDDPSQSSELLSEAKKLNDSQAPK

SEQ ID NO: 1053 - protein, 58 aa, ARTIFICIAL SEQUENCE
  Engineered IL6 binding polypeptide
VDAKYAKEEYQAWVEIHNLPNLTVDQMAAFITKLFDDPSQSSELLSEAKKLNDSQAPK

SEQ ID NO: 1054 - protein, 58 aa, ARTIFICIAL SEQUENCE
  Engineered IL6 binding polypeptide
VDAKYAKEEKKAWREIHLLPNLTINQIAAFITKLFDDPSQSSELLSEAKKLNDSQAPK

SEQ ID NO: 1055 - protein, 58 aa, ARTIFICIAL SEQUENCE
  Engineered IL6 binding polypeptide
VDAKYAKEEQDAWIEIHLLPNLTIDQMAAFITKLFDDPSQSSELLSEAKKLNDSQAPK

SEQ ID NO: 1056 - protein, 58 aa, ARTIFICIAL SEQUENCE
  Engineered IL6 binding polypeptide
VDAKYAKEEHDAWWEIHALPNLTINQMAAFISKLFDDPSQSSELLSEAKKLNDSQAPK

SEQ ID NO: 1057 - protein, 58 aa, ARTIFICIAL SEQUENCE
  Engineered IL6 binding polypeptide
VDAKYAKEEYDAWYEIHLLPNLTIQQMAAFISKLFDDPSQSSELLSEAKKLNDSQAPK

SEQ ID NO: 1058 - protein, 58 aa, ARTIFICIAL SEQUENCE
  Engineered IL6 binding polypeptide
VDAKYAKEEYQAWVEIHILPNLTIQQIAAFITKLFDDPSQSSELLSEAKKLNDSQAPK

SEQ ID NO: 1059 - protein, 58 aa, ARTIFICIAL SEQUENCE
  Engineered IL6 binding polypeptide
VDAKYAKEESKAWNEIHKLPNLTITQMAAFITKLFDDPSQSSELLSEAKKLNDSQAPK

SEQ ID NO: 1060 - protein, 58 aa, ARTIFICIAL SEQUENCE
  Engineered IL6 binding polypeptide
VDAKYAKEEYQAWYEIHLLPNLTVEQMAAFITKLFDDPSQSSELLSEAKKLNDSQAPK

SEQ ID NO: 1061 - protein, 58 aa, ARTIFICIAL SEQUENCE
  Engineered IL6 binding polypeptide
VDAKYAKEEKRAWMEIHLLPNLTVGQMAAFITKLFDDPSQSSELLSEAKKLNDSQAPK

SEQ ID NO: 1062 - protein, 58 aa, ARTIFICIAL SEQUENCE
  Engineered IL6 binding polypeptide
VDAKYAKEERVAWLEIHILPNLTIGQIAAFITKLFDDPSQSSELLSEAKKLNDSQAPK

SEQ ID NO: 1063 - protein, 58 aa, ARTIFICIAL SEQUENCE
  Engineered IL6 binding polypeptide
VDAKYAKEEQAAWYEIHLLPNLTIEQMAAFITKLFDDPSQSSELLSEAKKLNDSQAPK

SEQ ID NO: 1064 - protein, 58 aa, ARTIFICIAL SEQUENCE
  Engineered IL6 binding polypeptide
VDAKYAKEEKDAWYEIHILPNLTVSQIAAFITKLFDDPSQSSELLSEAKKLNDSQAPK

SEQ ID NO: 1065 - protein, 58 aa, ARTIFICIAL SEQUENCE
  Engineered IL6 binding polypeptide
VDAKYAKEEKKAWYEIHLLPNLTISQMAAFITKLFDDPSQSSELLSEAKKLNDSQAPK

SEQ ID NO: 1066 - protein, 58 aa, ARTIFICIAL SEQUENCE
  Engineered IL6 binding polypeptide
VDAKYAKEEKKAWYEIHLLPNLTINQMAAFITKLFDDPSQSSELLSEAKKLNDSQAPK

SEQ ID NO: 1067 - protein, 58 aa, ARTIFICIAL SEQUENCE
  Engineered IL6 binding polypeptide
VDAKYAKEEHKAWTEIHLLPNLTVDQIAAFITKLFDDPSQSSELLSEAKKLNDSQAPK

SEQ ID NO: 1068 - protein, 58 aa, ARTIFICIAL SEQUENCE
  Engineered IL6 binding polypeptide
VDAKYAKEEAAAWHEIHLLPNLTIDQMAAFITKLFDDPSQSSELLSEAKKLNDSQAPK

SEQ ID NO: 1069 - protein, 58 aa, ARTIFICIAL SEQUENCE
  Engineered IL6 binding polypeptide
VDAKYAKEERSAWTEIHLLPNLTITQIAAFITKLFDDPSQSSELLSEAKKLNDSQAPK

SEQ ID NO: 1070 - protein, 58 aa, ARTIFICIAL SEQUENCE
  Engineered IL6 binding polypeptide
VDAKYAKEERLAWQEIHRLPNLTVDQMAAFITKLFDDPSQSSELLSEAKKLNDSQAPK

SEQ ID NO: 1071 - protein, 58 aa, ARTIFICIAL SEQUENCE
  Engineered IL6 binding polypeptide
VDAKYAKEEKDAWTEIHLLPNLTVEQMAAFISKLFDDPSQSSELLSEAKKLNDSQAPK

SEQ ID NO: 1072 - protein, 58 aa, ARTIFICIAL SEQUENCE
  Engineered IL6 binding polypeptide
VDAKYAKEEKAAWMEIHNLPNLTIDQMAAFITKLFDDPSQSSELLSEAKKLNDSQAPK

SEQ ID NO: 1073 - protein, 58 aa, ARTIFICIAL SEQUENCE
  Engineered IL6 binding polypeptide
VDAKYAKEEYEAWVEIHNLPNLTIDQMAAFITKLFDDPSQSSELLSEAKKLNDSQAPK

SEQ ID NO: 1074 - protein, 58 aa, ARTIFICIAL SEQUENCE
  Engineered IL6 binding polypeptide
VDAKYAKEEAKAWTEIHLLPNLTVNQIAAFITKLFDDPSQSSELLSEAKKLNDSQAPK

SEQ ID NO: 1075 - protein, 58 aa, ARTIFICIAL SEQUENCE
  Engineered IL6 binding polypeptide
VDAKYAKEEKKAWYEIHILPNLTIHQIAAFITKLFDDPSQSSELLSEAKKLNDSQAPK

SEQ ID NO: 1076 - protein, 58 aa, ARTIFICIAL SEQUENCE
  Engineered IL6 binding polypeptide
VDAKYAKEEKKAWFEIHLLPNLTVDQMAAFISKLFDDPSQSSELLSEAKKLNDSQAPK

SEQ ID NO: 1077 - protein, 58 aa, ARTIFICIAL SEQUENCE
  Engineered IL6 binding polypeptide
VDAKYAKEERKAWFEIHSLPNLTIDQMAAFITKLFDDPSQSSELLSEAKKLNDSQAPK

SEQ ID NO: 1078 - protein, 58 aa, ARTIFICIAL SEQUENCE
  Engineered IL6 binding polypeptide
VDAKYAKEERNAWYEIHLLPNLTVDQMAAFITKLFDDPSQSSELLSEAKKLNDSQAPK

SEQ ID NO: 1079 - protein, 58 aa, ARTIFICIAL SEQUENCE
  Engineered IL6 binding polypeptide
VDAKYAKEEASAWKEIHLLPNLTIDQVAAFITKLFDDPSQSSELLSEAKKLNDSQAPK

SEQ ID NO: 1080 - protein, 58 aa, ARTIFICIAL SEQUENCE
  Engineered IL6 binding polypeptide
VDAKYAKEEAAAWKEIHLLPNLTIDQMAAFISKLFDDPSQSSELLSEAKKLNDSQAPK

SEQ ID NO: 1081 - protein, 58 aa, ARTIFICIAL SEQUENCE
  Engineered IL6 binding polypeptide
VDAKYAKEEAWAWHEIHILPNLTIEQMAAFITKLFDDPSQSSELLSEAKKLNDSQAPK

SEQ ID NO: 1082 - protein, 58 aa, ARTIFICIAL SEQUENCE
  Engineered IL6 binding polypeptide
VDAKYAKEEKYAWLEIHKLPNLTVDQVAAFITKLFDDPSQSSELLSEAKKLNDSQAPK

SEQ ID NO: 1083 - protein, 58 aa, ARTIFICIAL SEQUENCE
  Engineered IL6 binding polypeptide
VDAKYAKEERSAWMEIHLLPNLTINQMAAFISKLFDDPSQSSELLSEAKKLNDSQAPK

SEQ ID NO: 1084 - protein, 58 aa, ARTIFICIAL SEQUENCE
  Engineered IL6 binding polypeptide
VDAKYAKEERMAWNEIHGLPNLTVDQMAAFITKLFDDPSQSSELLSEAKKLNDSQAPK

SEQ ID NO: 1085 - protein, 58 aa, ARTIFICIAL SEQUENCE
  Engineered IL6 binding polypeptide
VDAKYAKEEAKAWYEIHILPNLTIIQMAAFITKLFDDPSQSSELLSEAKKLNDSQAPK

SEQ ID NO: 1086 - protein, 58 aa, ARTIFICIAL SEQUENCE
  Engineered IL6 binding polypeptide
VDAKYAKEEKWAWTEIHKLPNLTISQMAAFITKLFDDPSQSSELLSEAKKLNDSQAPK

SEQ ID NO: 1087 - protein, 58 aa, ARTIFICIAL SEQUENCE
  Engineered IL6 binding polypeptide
VDAKYAKEERMAWTEIHNLPNLTIEQMAAFITKLFDDPSQSSELLSEAKKLNDSQAPK

SEQ ID NO: 1088 - protein, 58 aa, ARTIFICIAL SEQUENCE
  Engineered IL6 binding polypeptide
VDAKYAKEEEWAWKEIHILPNLTVEQVAAFITKLFDDPSQSSELLSEAKKLNDSQAPK

SEQ ID NO: 1089 - protein, 58 aa, ARTIFICIAL SEQUENCE
  Engineered IL6 binding polypeptide
VDAKYAKEEKFAWTEIHKLPNLTVDQMAAFITKLFDDPSQSSELLSEAKKLNDSQAPK

SEQ ID NO: 1090 - protein, 58 aa, ARTIFICIAL SEQUENCE
  Engineered IL6 binding polypeptide
VDAKYAKEEHYAWQEIHKLPNLTIDQMAAFITKLFDDPSQSSELLSEAKKLNDSQAPK

SEQ ID NO: 1091 - protein, 58 aa, ARTIFICIAL SEQUENCE
  Engineered IL6 binding polypeptide
VDAKYAKEERKAWYEIHILPNLTITQIAAFITKLFDDPSQSSELLSEAKKLNDSQAPK

SEQ ID NO: 1092 - protein, 58 aa, ARTIFICIAL SEQUENCE
  Engineered IL6 binding polypeptide
VDAKYAKEERYAWTEIHKLPNLTVDQVAAFISKLFDDPSQSSELLSEAKKLNDSQAPK

SEQ ID NO: 1093 - protein, 58 aa, ARTIFICIAL SEQUENCE
  Engineered IL6 binding polypeptide
VDAKYAKEEKEAWYEIHILPNLTVSQIAAFITKLFDDPSQSSELLSEAKKLNDSQAPK

SEQ ID NO: 1094 - protein, 58 aa, ARTIFICIAL SEQUENCE
  Engineered IL6 binding polypeptide
VDAKYAKEEYSAWFEIHILPNLTVEQMAAFISKLFDDPSQSSELLSEAKKLNDSQAPK

SEQ ID NO: 1095 - protein, 58 aa, ARTIFICIAL SEQUENCE
  Engineered IL6 binding polypeptide
VDAKYAKEERMAWNEIHKLPNLTIDQMAAFISKLFDDPSQSSELLSEAKKLNDSQAPK

SEQ ID NO: 1096 - protein, 58 aa, ARTIFICIAL SEQUENCE
  Engineered IL6 binding polypeptide
VDAKYAKEEAKAWTEIHLLPNLTVNQVAAFITKLFDDPSQSSELLSEAKKLNDSQAPK

SEQ ID NO: 1097 - protein, 58 aa, ARTIFICIAL SEQUENCE
  Engineered IL6 binding polypeptide
VDAKYAKEEKFAWREIHLLPNLTIEQMAAFISKLFDDPSQSSELLSEAKKLNDSQAPK

SEQ ID NO: 1098 - protein, 58 aa, ARTIFICIAL SEQUENCE
  Engineered IL6 binding polypeptide
VDAKYAKEEANAWHEIHLLPNLTIDQMAAFITKLFDDPSQSSELLSEAKKLNDSQAPK

SEQ ID NO: 1099 - protein, 58 aa, ARTIFICIAL SEQUENCE
  Engineered IL6 binding polypeptide
VDAKYAKEEKHAWNEIHRLPNLTVEQMAAFITKLFDDPSQSSELLSEAKKLNDSQAPK

SEQ ID NO: 1100 - protein, 58 aa, ARTIFICIAL SEQUENCE
  Engineered IL6 binding polypeptide
VDAKYAKEEHMAWTEIHALPNLTVDQMAAFISKLFDDPSQSSELLSEAKKLNDSQAPK

SEQ ID NO: 1101 - protein, 58 aa, ARTIFICIAL SEQUENCE
  Engineered IL6 binding polypeptide
VDAKYAKEEYEAWMEIHNLPNLTVDQMAAFITKLFDDPSQSSELLSEAKKLNDSQAPK

SEQ ID NO: 1102 - protein, 58 aa, ARTIFICIAL SEQUENCE
  Engineered IL6 binding polypeptide
VDAKYAKEERAAWYEIHILPNLTVEQMAAFITKLFDDPSQSSELLSEAKKLNDSQAPK

SEQ ID NO: 1103 - protein, 58 aa, ARTIFICIAL SEQUENCE
  Engineered IL6 binding polypeptide
VDAKYAKEEKNAWYEIHLLPNLTVVQMAAFITKLFDDPSQSSELLSEAKKLNDSQAPK

SEQ ID NO: 1104 - protein, 58 aa, ARTIFICIAL SEQUENCE
  Engineered IL6 binding polypeptide
VDAKYAKEEQIAWYEIHILPNLTVDQVAAFISKLFDDPSQSSELLSEAKKLNDSQAPK

SEQ ID NO: 1105 - protein, 58 aa, ARTIFICIAL SEQUENCE
  Engineered IL6 binding polypeptide
VDAKYAKEEYYAWTEIHRLPNLTVDQMAAFITKLFDDPSQSSELLSEAKKLNDSQAPK

SEQ ID NO: 1106 - protein, 58 aa, ARTIFICIAL SEQUENCE
  Engineered IL6 binding polypeptide
VDAKYAKEEADAWFEIHILPNLTVDQIAAFITKLFDDPSQSSELLSEAKKLNDSQAPK

SEQ ID NO: 1107 - protein, 58 aa, ARTIFICIAL SEQUENCE
  Engineered IL6 binding polypeptide
VDAKYAKEEKEAWMEIHKLPNLTVDQMAAFITKLFDDPSQSSELLSEAKKLNDSQAPK

SEQ ID NO: 1108 - protein, 58 aa, ARTIFICIAL SEQUENCE
  Engineered IL6 binding polypeptide
VDAKYAKEEYLAWIEIHALPNLTVSQMAAFITKLFDDPSQSSELLSEAKKLNDSQAPK

SEQ ID NO: 1109 - protein, 58 aa, ARTIFICIAL SEQUENCE
  Engineered IL6 binding polypeptide
VDAKYAKEEAFAWWEIHKLPNLTINQMAAFITKLFDDPSQSSELLSEAKKLNDSQAPK

SEQ ID NO: 1110 - protein, 58 aa, ARTIFICIAL SEQUENCE
  Engineered IL6 binding polypeptide
VDAKYAKEEYNAWFEIHILPNLTISQMAAFITKLFDDPSQSSELLSEAKKLNDSQAPK

SEQ ID NO: 1111 - protein, 58 aa, ARTIFICIAL SEQUENCE
  Engineered IL6 binding polypeptide
VDAKYAKEEKEAWREIHILPNLTVDQMAAFISKLFDDPSQSSELLSEAKKLNDSQAPK

SEQ ID NO: 1112 - protein, 58 aa, ARTIFICIAL SEQUENCE
  Engineered IL6 binding polypeptide
VDAKYAKEEKKAWHEIHILPNLTIGQMAAFISKLFDDPSQSSELLSEAKKLNDSQAPK

SEQ ID NO: 1113 - protein, 58 aa, ARTIFICIAL SEQUENCE
  Engineered IL6 binding polypeptide
VDAKYAKEEYHAWTEIHKLPNLTINQMAAFISKLFDDPSQSSELLSEAKKLNDSQAPK

SEQ ID NO: 1114 - protein, 58 aa, ARTIFICIAL SEQUENCE
  Engineered IL6 binding polypeptide
VDAKYAKEEFSAWYEIHLLPNLTVDQMAAFITKLFDDPSQSSELLSEAKKLNDSQAPK

SEQ ID NO: 1115 - protein, 58 aa, ARTIFICIAL SEQUENCE
  Engineered IL6 binding polypeptide
VDAKYAKEERAAWWEIHTLPNLTVDQMAAFISKLFDDPSQSSELLSEAKKLNDSQAPK

SEQ ID NO: 1116 - protein, 58 aa, ARTIFICIAL SEQUENCE
  Engineered IL6 binding polypeptide
VDAKYAKEEYEAWVEIHLLPNLTIDQMAAFISKLFDDPSQSSELLSEAKKLNDSQAPK

SEQ ID NO: 1117 - protein, 58 aa, ARTIFICIAL SEQUENCE
  Engineered IL6 binding polypeptide
VDAKYAKEEAEAWVEIHLLPNLTVNQMAAFITKLFDDPSQSSELLSEAKKLNDSQAPK

SEQ ID NO: 1118 - protein, 58 aa, ARTIFICIAL SEQUENCE
  Engineered IL6 binding polypeptide
VDAKYAKEEAKAWHEIHILPNLTITQIAAFITKLFDDPSQSSELLSEAKKLNDSQAPK

SEQ ID NO: 1119 - protein, 58 aa, ARTIFICIAL SEQUENCE
  Engineered IL6 binding polypeptide
VDAKYAKEEFYAWNEIHKLPNLTVNQMAAFITKLFDDPSQSSELLSEAKKLNDSQAPK

SEQ ID NO: 1120 - protein, 58 aa, ARTIFICIAL SEQUENCE
  Engineered IL6 binding polypeptide
VDAKYAKEEYLAWTEIHLLPNLTIEQMAAFITKLFDDPSQSSELLSEAKKLNDSQAPK

SEQ ID NO: 1121 - protein, 58 aa, ARTIFICIAL SEQUENCE
  Engineered IL6 binding polypeptide
VDAKYAKEEHAAWREIHALPNLTVDQMAAFISKLFDDPSQSSELLSEAKKLNDSQAPK

SEQ ID NO: 1122 - protein, 58 aa, ARTIFICIAL SEQUENCE
  Engineered IL6 binding polypeptide
VDAKYAKEEQRAWMEIHLLPNLTIEQIAAFISKLFDDPSQSSELLSEAKKLNDSQAPK

SEQ ID NO: 1123 - protein, 58 aa, ARTIFICIAL SEQUENCE
  Engineered IL6 binding polypeptide
VDAKYAKEERDAWTEIHKLPNLTVDQMAAFITKLFDDPSQSSELLSEAKKLNDSQAPK

SEQ ID NO: 1124 - protein, 58 aa, ARTIFICIAL SEQUENCE
  Engineered IL6 binding polypeptide
VDAKYAKEERDAWFEIHRLPNLTVDQMAAFITKLFDDPSQSSELLSEAKKLNDSQAPK

SEQ ID NO: 1125 - protein, 58 aa, ARTIFICIAL SEQUENCE
  Engineered IL6 binding polypeptide
VDAKYAKEESYAWTEIHKLPNLTIDQMAAFITKLFDDPSQSSELLSEAKKLNDSQAPK

SEQ ID NO: 1126 - protein, 58 aa, ARTIFICIAL SEQUENCE
  Engineered IL6 binding polypeptide
VDAKYAKEEKFAWKEIHILPNLTIDQIAAFITKLFDDPSQSSELLSEAKKLNDSQAPK

SEQ ID NO: 1127 - protein, 58 aa, ARTIFICIAL SEQUENCE
  Engineered IL6 binding polypeptide
VDAKYAKEEHRAWMEIHQLPNLTVDQMAAFITKLFDDPSQSSELLSEAKKLNDSQAPK

SEQ ID NO: 1128 - protein, 58 aa, ARTIFICIAL SEQUENCE
  Engineered IL6 binding polypeptide
VDAKYAKEERTAWFEIHKLPNLTVDQMAAFITKLFDDPSQSSELLSEAKKLNDSQAPK

SEQ ID NO: 1129 - protein, 58 aa, ARTIFICIAL SEQUENCE
  Engineered IL6 binding polypeptide
VDAKYAKEERYAWWEIHKLPNLTVEQVAAFITKLFDDPSQSSELLSEAKKLNDSQAPK

SEQ ID NO: 1130 - protein, 58 aa, ARTIFICIAL SEQUENCE
  Engineered IL6 binding polypeptide
VDAKYAKEEEEAWNEIHRLPNLTVVQMAAFISKLFDDPSQSSELLSEAKKLNDSQAPK

SEQ ID NO: 1131 - protein, 58 aa, ARTIFICIAL SEQUENCE
  Engineered IL6 binding polypeptide
VDAKYAKEEYEAWVEIHILPNLTVEQMAAFITKLFDDPSQSSELLSEAKKLNDSQAPK

SEQ ID NO: 1132 - protein, 58 aa, ARTIFICIAL SEQUENCE
  Engineered IL6 binding polypeptide
VDAKYAKEEYHAWTEIHLLPNLTIEQMAAFITKLFDDPSQSSELLSEAKKLNDSQAPK

SEQ ID NO: 1133 - protein, 58 aa, ARTIFICIAL SEQUENCE
  Engineered IL6 binding polypeptide
VDAKYAKEEYNAWYEIHVLPNLTIDQIAAFITKLFDDPSQSSELLSEAKKLNDSQAPK

SEQ ID NO: 1134 - protein, 58 aa, ARTIFICIAL SEQUENCE
  Engineered IL6 binding polypeptide
VDAKYAKEERKAWYEIHILPNLTVHQIAAFITKLFDDPSQSSELLSEAKKLNDSQAPK

SEQ ID NO: 1135 - protein, 58 aa, ARTIFICIAL SEQUENCE
  Engineered IL6 binding polypeptide
VDAKYAKEEWAAWIEIHSLPNLTVDQMAAFITKLFDDPSQSSELLSEAKKLNDSQAPK

SEQ ID NO: 1136 - protein, 58 aa, ARTIFICIAL SEQUENCE
  Engineered IL6 binding polypeptide
VDAKYAKEEAIAWSEIHSLPNLTVGQMAAFITKLFDDPSQSSELLSEAKKLNDSQAPK

SEQ ID NO: 1137 - protein, 58 aa, ARTIFICIAL SEQUENCE
  Engineered IL6 binding polypeptide
VDAKYAKEEKYAWTEIHILPNLTIDQMAAFISKLFDDPSQSSELLSEAKKLNDSQAPK

SEQ ID NO: 1138 - protein, 58 aa, ARTIFICIAL SEQUENCE
  Engineered IL6 binding polypeptide
VDAKYAKEEHTAWREIHLLPNLTISQMAAFITKLFDDPSQSSELLSEAKKLNDSQAPK

SEQ ID NO: 1139 - protein, 58 aa, ARTIFICIAL SEQUENCE
  Engineered IL6 binding polypeptide
VDAKYAKEEYTAWYEIHLLPNLTIEQMAAFISKLFDDPSQSSELLSEAKKLNDSQAPK

SEQ ID NO: 1140 - protein, 58 aa, ARTIFICIAL SEQUENCE
  Engineered IL6 binding polypeptide
VDAKYAKEEYEAWYEIHILPNLTVRQMAAFISKLFDDPSQSSELLSEAKKLNDSQAPK

SEQ ID NO: 1141 - protein, 58 aa, ARTIFICIAL SEQUENCE
  Engineered IL6 binding polypeptide
VDAKYAKEEKHAWTEIHLLPNLTISQMAAFITKLFDDPSQSSELLSEAKKLNDSQAPK

SEQ ID NO: 1142 - protein, 58 aa, ARTIFICIAL SEQUENCE
  Engineered IL6 binding polypeptide
VDAKYAKEEYTAWYEIHVLPNLTIRQMAAFITKLFDDPSQSSELLSEAKKLNDSQAPK

SEQ ID NO: 1143 - protein, 58 aa, ARTIFICIAL SEQUENCE
  Engineered IL6 binding polypeptide
VDAKYAKEEQRAWYEIHTLPNLTIDQMAAFITKLFDDPSQSSELLSEAKKLNDSQAPK

SEQ ID NO: 1144 - protein, 58 aa, ARTIFICIAL SEQUENCE
  Engineered IL6 binding polypeptide
VDAKYAKEEAVAWKEIHLLPNLTIDQIAAFISKLFDDPSQSSELLSEAKKLNDSQAPK

SEQ ID NO: 1145 - protein, 58 aa, ARTIFICIAL SEQUENCE
  Engineered IL6 binding polypeptide
VDAKYAKEEYRAWMEIHALPNLTIVQIAAFITKLFDDPSQSSELLSEAKKLNDSQAPK

SEQ ID NO: 1146 - protein, 58 aa, ARTIFICIAL SEQUENCE
  Engineered IL6 binding polypeptide
VDAKYAKEERSAWNEIHKLPNLTIDQMAAFITKLFDDPSQSSELLSEAKKLNDSQAPK

SEQ ID NO: 1147 - protein, 58 aa, ARTIFICIAL SEQUENCE
  Engineered IL6 binding polypeptide
VDAKYAKEEAEAWFEIHILPNLTVGQIAAFITKLFDDPSQSSELLSEAKKLNDSQAPK

SEQ ID NO: 1148 - protein, 58 aa, ARTIFICIAL SEQUENCE
  Engineered IL6 binding polypeptide
VDAKYAKEEKMAWNEIHKLPNLTVEQIAAFITKLFDDPSQSSELLSEAKKLNDSQAPK

SEQ ID NO: 1149 - protein, 58 aa, ARTIFICIAL SEQUENCE
  Engineered IL6 binding polypeptide
VDAKYAKEERTAWMEIHKLPNLTIDQMAAFISKLFDDPSQSSELLSEAKKLNDSQAPK

SEQ ID NO: 1150 - protein, 58 aa, ARTIFICIAL SEQUENCE
  Engineered IL6 binding polypeptide
VDAKYAKEEYEAWYEIHALPNLTLHQMAAFISKLFDDPSQSSELLSEAKKLNDSQAPK

SEQ ID NO: 1151 - protein, 58 aa, ARTIFICIAL SEQUENCE
  Engineered IL6 binding polypeptide
VDAKYAKEEYDAWFEIHVLPNLTVNQMAAFITKLFDDPSQSSELLSEAKKLNDSQAPK

SEQ ID NO: 1152 - protein, 58 aa, ARTIFICIAL SEQUENCE
  Engineered IL6 binding polypeptide
VDAKYAKEESLAWMEIHKLPNLTVDQVAAFITKLFDDPSQSSELLSEAKKLNDSQAPK

SEQ ID NO: 1153 - protein, 58 aa, ARTIFICIAL SEQUENCE
  Engineered IL6 binding polypeptide
VDAKYAKEERNAWWEIHALPNLTVNQMAAFITKLFDDPSQSSELLSEAKKLNDSQAPK

SEQ ID NO: 1154 - protein, 58 aa, ARTIFICIAL SEQUENCE
  Engineered IL6 binding polypeptide
VDAKYAKEEKKAWKEIHLLPNLTVNQMAAFISKLFDDPSQSSELLSEAKKLNDSQAPK

SEQ ID NO: 1155 - protein, 58 aa, ARTIFICIAL SEQUENCE
  Engineered IL6 binding polypeptide
VDAKYAKEEKYAWTEIHNLPNLTILQMAAFITKLFDDPSQSSELLSEAKKLNDSQAPK

SEQ ID NO: 1156 - protein, 58 aa, ARTIFICIAL SEQUENCE
  Engineered IL6 binding polypeptide
VDAKYAKEEYKAWVEIHLLPNLTVDQMAAFISKLFDDPSQSSELLSEAKKLNDSQAPK

SEQ ID NO: 1157 - protein, 58 aa, ARTIFICIAL SEQUENCE
  Engineered IL6 binding polypeptide
VDAKYAKEEHAAWLEIHLLPNLTVSQIAAFITKLFDDPSQSSELLSEAKKLNDSQAPK

SEQ ID NO: 1158 - protein, 58 aa, ARTIFICIAL SEQUENCE
  Engineered IL6 binding polypeptide
VDAKYAKEEYHAWWEIHALPNLTVEQMAAFITKLFDDPSQSSELLSEAKKLNDSQAPK

SEQ ID NO: 1159 - protein, 58 aa, ARTIFICIAL SEQUENCE
  Engineered IL6 binding polypeptide
VDAKYAKEERYAWNEIHRLPNLTVDQMAAFITKLFDDPSQSSELLSEAKKLNDSQAPK

SEQ ID NO: 1160 - protein, 58 aa, ARTIFICIAL SEQUENCE
  Engineered IL6 binding polypeptide
VDAKYAKEEAQAWMEIHLLPNLTIAQMAAFITKLFDDPSQSSELLSEAKKLNDSQAPK

SEQ ID NO: 1161 - protein, 58 aa, ARTIFICIAL SEQUENCE
  Engineered IL6 binding polypeptide
VDAKYAKEEREAWYEIHILPNLTVNQMAAFITKLFDDPSQSSELLSEAKKLNDSQAPK

SEQ ID NO: 1162 - protein, 58 aa, ARTIFICIAL SEQUENCE
  Engineered IL6 binding polypeptide
VDAKYAKEEAYAWNEIHKLPNLTVEQMAAFISKLFDDPSQSSELLSEAKKLNDSQAPK

SEQ ID NO: 1163 - protein, 58 aa, ARTIFICIAL SEQUENCE
  Engineered IL6 binding polypeptide
VDAKYAKEEYDAWAEIHRLPNLTISQMAAFITKLFDDPSQSSELLSEAKKLNDSQAPK

SEQ ID NO: 1164 - protein, 58 aa, ARTIFICIAL SEQUENCE
  Engineered IL6 binding polypeptide
VDAKYAKEEYHAWTEIHILPNLTINQIAAFITKLFDDPSQSSELLSEAKKLNDSQAPK

SEQ ID NO: 1165 - protein, 58 aa, ARTIFICIAL SEQUENCE
  Engineered IL6 binding polypeptide
VDAKYAKEERQAWFEIHILPNLTVGQMAAFISKLFDDPSQSSELLSEAKKLNDSQAPK

SEQ ID NO: 1166 - protein, 58 aa, ARTIFICIAL SEQUENCE
  Engineered IL6 binding polypeptide
VDAKYAKEEAEAWFEIHILPNLTVDQIAAFITKLFDDPSQSSELLSEAKKLNDSQAPK

SEQ ID NO: 1167 - protein, 58 aa, ARTIFICIAL SEQUENCE
  Engineered IL6 binding polypeptide
VDAKYAKEEKKAWYEIHILPNLTVYQMAAFITKLFDDPSQSSELLSEAKKLNDSQAPK

SEQ ID NO: 1168 - protein, 58 aa, ARTIFICIAL SEQUENCE
  Engineered IL6 binding polypeptide
VDAKYAKEEKAAWHEIHILPNLTVHQMAAFITKLFDDPSQSSELLSEAKKLNDSQAPK

SEQ ID NO: 1169 - protein, 58 aa, ARTIFICIAL SEQUENCE
  Engineered IL6 binding polypeptide
VDAKYAKEEAQAWNEIHKLPNLTVEQMAAFISKLFDDPSQSSELLSEAKKLNDSQAPK

SEQ ID NO: 1170 - protein, 58 aa, ARTIFICIAL SEQUENCE
  Engineered IL6 binding polypeptide
VDAKYAKEEYEAWYEIHILPNLTVHQIAAFITKLFDDPSQSSELLSEAKKLNDSQAPK

SEQ ID NO: 1171 - protein, 58 aa, ARTIFICIAL SEQUENCE
  Engineered IL6 binding polypeptide
VDAKYAKEEYEAWMEIHLLPNLTVHQMAAFITKLFDDPSQSSELLSEAKKLNDSQAPK

SEQ ID NO: 1172 - protein, 58 aa, ARTIFICIAL SEQUENCE
  Engineered IL6 binding polypeptide
VDAKYAKEEYDAWFEIHVLPNLTINQMAAFITKLFDDPSQSSELLSEAKKLNDSQAPK

SEQ ID NO: 1173 - protein, 58 aa, ARTIFICIAL SEQUENCE
  Engineered IL6 binding polypeptide
VDAKYAKEEKRAWNEIHQLPNLTIEQIAAFITKLFDDPSQSSELLSEAKKLNDSQAPK

SEQ ID NO: 1174 - protein, 58 aa, ARTIFICIAL SEQUENCE
  Engineered IL6 binding polypeptide
VDAKYAKEEARAWWEIHLLPNLTVDQIAAFITKLFDDPSQSSELLSEAKKLNDSQAPK

SEQ ID NO: 1175 - protein, 58 aa, ARTIFICIAL SEQUENCE
  Engineered IL6 binding polypeptide
VDAKYAKEEKHAWREIHILPNLTVDQIAAFITKLFDDPSQSSELLSEAKKLNDSQAPK

SEQ ID NO: 1176 - protein, 58 aa, ARTIFICIAL SEQUENCE
  Engineered IL6 binding polypeptide
VDAKYAKEESRAWTEIHLLPNLTVDQMAAFITKLFDDPSQSSELLSEAKKLNDSQAPK

SEQ ID NO: 1177 - protein, 58 aa, ARTIFICIAL SEQUENCE
  Engineered IL6 binding polypeptide
VDAKYAKEEAEAWKEIHLLPNLTIGQIAAFITKLFDDPSQSSELLSEAKKLNDSQAPK

SEQ ID NO: 1178 - protein, 58 aa, ARTIFICIAL SEQUENCE
  Engineered IL6 binding polypeptide
VDAKYAKEEADAWKEIHLLPNLTIEQMAAFITKLFDDPSQSSELLSEAKKLNDSQAPK

SEQ ID NO: 1179 - protein, 58 aa, ARTIFICIAL SEQUENCE
  Engineered IL6 binding polypeptide
VDAKYAKEEYQAWMEIHILPNLTIEQMAAFITKLFDDPSQSSELLSEAKKLNDSQAPK

SEQ ID NO: 1180 - protein, 58 aa, ARTIFICIAL SEQUENCE
  Engineered IL6 binding polypeptide
VDAKYAKEEAHAWWEIHKLPNLTVNQMAAFITKLFDDPSQSSELLSEAKKLNDSQAPK

SEQ ID NO: 1181 - protein, 58 aa, ARTIFICIAL SEQUENCE
  Engineered IL6 binding polypeptide
VDAKYAKEEWYAWNEIHKLPNLTVDQMAAFISKLFDDPSQSSELLSEAKKLNDSQAPK

SEQ ID NO: 1182 - protein, 58 aa, ARTIFICIAL SEQUENCE
  Engineered IL6 binding polypeptide
VDAKYAKEEKKAWNEIHNLPNLTVDQMAAFITKLFDDPSQSSELLSEAKKLNDSQAPK

SEQ ID NO: 1183 - protein, 58 aa, ARTIFICIAL SEQUENCE
  Engineered IL6 binding polypeptide
VDAKYAKEEAAAWMEIHGLPNLTVDQVAAFISKLFDDPSQSSELLSEAKKLNDSQAPK

SEQ ID NO: 1184 - protein, 58 aa, ARTIFICIAL SEQUENCE
  Engineered IL6 binding polypeptide
VDAKYAKEEKFAWREIHILPNLTVEQMAAFITKLFDDPSQSSELLSEAKKLNDSQAPK

SEQ ID NO: 1185 - protein, 58 aa, ARTIFICIAL SEQUENCE
  Engineered IL6 binding polypeptide
VDAKYAKEEYHAWTEIHQLPNLTIDQMAAFISKLFDDPSQSSELLSEAKKLNDSQAPK

SEQ ID NO: 1186 - protein, 58 aa, ARTIFICIAL SEQUENCE
  Engineered IL6 binding polypeptide
VDAKYAKEEAMAWNEIHRLPNLTVNQMAAFITKLFDDPSQSSELLSEAKKLNDSQAPK

SEQ ID NO: 1187 - protein, 58 aa, ARTIFICIAL SEQUENCE
  Engineered IL6 binding polypeptide
VDAKYAKEEQKAWREIHILPNLTVNQMAAFISKLFDDPSQSSELLSEAKKLNDSQAPK

SEQ ID NO: 1188 - protein, 58 aa, ARTIFICIAL SEQUENCE
  Engineered IL6 binding polypeptide
VDAKYAKEEFAAWLEIHKLPNLTIDQMAAFITKLFDDPSQSSELLSEAKKLNDSQAPK

SEQ ID NO: 1189 - protein, 58 aa, ARTIFICIAL SEQUENCE
  Engineered IL6 binding polypeptide
VDAKYAKEEAYAWAEIHKLPNLTVNQMAAFITKLFDDPSQSSELLSEAKKLNDSQAPK

SEQ ID NO: 1190 - protein, 58 aa, ARTIFICIAL SEQUENCE
  Engineered IL6 binding polypeptide
VDAKYAKEEKDAWYEIHILPNLTVRQMAAFISKLFDDPSQSSELLSEAKKLNDSQAPK

SEQ ID NO: 1191 - protein, 58 aa, ARTIFICIAL SEQUENCE
  Engineered IL6 binding polypeptide
VDAKYAKEEKDAWMEIHLLPNLTVSQIAAFITKLFDDPSQSSELLSEAKKLNDSQAPK

SEQ ID NO: 1192 - protein, 58 aa, ARTIFICIAL SEQUENCE
  Engineered IL6 binding polypeptide
VDAKYAKEEKEAWTEIHKLPNLTINQMAAFISKLFDDPSQSSELLSEAKKLNDSQAPK

SEQ ID NO: 1193 - protein, 58 aa, ARTIFICIAL SEQUENCE
  Engineered IL6 binding polypeptide
VDAKYAKEEKDAWREIHILPNLTVDQMAAFISKLFDDPSQSSELLSEAKKLNDSQAPK

SEQ ID NO: 1194 - protein, 58 aa, ARTIFICIAL SEQUENCE
  Engineered IL6 binding polypeptide
VDAKYAKEEYRAWTEIHLLPNLTIEQMAAFISKLFDDPSQSSELLSEAKKLNDSQAPK

SEQ ID NO: 1195 - protein, 58 aa, ARTIFICIAL SEQUENCE
  Engineered IL6 binding polypeptide
VDAKYAKEEKFAWHEIHILPNLTVHQMAAFITKLFDDPSQSSELLSEAKKLNDSQAPK

SEQ ID NO: 1196 - protein, 58 aa, ARTIFICIAL SEQUENCE
  Engineered IL6 binding polypeptide
VDAKYAKEEWEAWLEIHALPNLTVEQMAAFITKLFDDPSQSSELLSEAKKLNDSQAPK

SEQ ID NO: 1197 - protein, 58 aa, ARTIFICIAL SEQUENCE
  Engineered IL6 binding polypeptide
VDAKYAKEEAAAWQEIHLLPNLTVGQIAAFITKLFDDPSQSSELLSEAKKLNDSQAPK

SEQ ID NO: 1198 - protein, 58 aa, ARTIFICIAL SEQUENCE
  Engineered IL6 binding polypeptide
VDAKYAKEEKVAWKEIHILPNLTVNQIAAFISKLFDDPSQSSELLSEAKKLNDSQAPK

SEQ ID NO: 1199 - protein, 58 aa, ARTIFICIAL SEQUENCE
  Engineered IL6 binding polypeptide
VDAKYAKEERVAWQEIHLLPNLTIEQMAAFITKLFDDPSQSSELLSEAKKLNDSQAPK

SEQ ID NO: 1200 - protein, 58 aa, ARTIFICIAL SEQUENCE
  Engineered IL6 binding polypeptide
VDAKYAKEEYEAWLEIHLLPNLTIDQMAAFITKLFDDPSQSSELLSEAKKLNDSQAPK

SEQ ID NO: 1201 - protein, 58 aa, ARTIFICIAL SEQUENCE
  Engineered IL6 binding polypeptide
VDAKYAKEEAEAWFEIHNLPNLTIDQMAAFITKLFDDPSQSSELLSEAKKLNDSQAPK

SEQ ID NO: 1202 - protein, 58 aa, ARTIFICIAL SEQUENCE
  Engineered IL6 binding polypeptide
VDAKYAKEEKYAWWEIHKLPNLTVRQMAAFITKLFDDPSQSSELLSEAKKLNDSQAPK

SEQ ID NO: 1203 - protein, 58 aa, ARTIFICIAL SEQUENCE
  Engineered IL6 binding polypeptide
VDAKYAKEEYDAWHEIHVLPNLTVSQIAAFISKLFDDPSQSSELLSEAKKLNDSQAPK

SEQ ID NO: 1204 - protein, 58 aa, ARTIFICIAL SEQUENCE
  Engineered IL6 binding polypeptide
VDAKYAKEEAAAWREIHLLPNLTVDQMAAFITKLFDDPSQSSELLSEAKKLNDSQAPK

SEQ ID NO: 1205 - protein, 58 aa, ARTIFICIAL SEQUENCE
  Engineered IL6 binding polypeptide
VDAKYAKEEKHAWNEIHKLPNLTVKQVAAFISKLFDDPSQSSELLSEAKKLNDSQAPK

SEQ ID NO: 1206 - protein, 58 aa, ARTIFICIAL SEQUENCE
  Engineered IL6 binding polypeptide
VDAKYAKEEYDAWTEIHLLPNLTIAQIAAFITKLFDDPSQSSELLSEAKKLNDSQAPK

SEQ ID NO: 1207 - protein, 58 aa, ARTIFICIAL SEQUENCE
  Engineered IL6 binding polypeptide
VDAKYAKEERKAWHEIHILPNLTVDQMAAFITKLFDDPSQSSELLSEAKKLNDSQAPK

SEQ ID NO: 1208 - protein, 58 aa, ARTIFICIAL SEQUENCE
  Engineered IL6 binding polypeptide
VDAKYAKEEHDAWHEIHLLPNLTVDQIAAFITKLFDDPSQSSELLSEAKKLNDSQAPK

SEQ ID NO: 1209 - protein, 58 aa, ARTIFICIAL SEQUENCE
  Engineered IL6 binding polypeptide
VDAKYAKEEYAAWNEIHKLPNLTIIQMAAFITKLFDDPSQSSELLSEAKKLNDSQAPK

SEQ ID NO: 1210 - protein, 58 aa, ARTIFICIAL SEQUENCE
  Engineered IL6 binding polypeptide
VDAKYAKEEYEAWMEIHLLPNLTIEQMAAFISKLFDDPSQSSELLSEAKKLNDSQAPK

SEQ ID NO: 1211 - protein, 58 aa, ARTIFICIAL SEQUENCE
  Engineered IL6 binding polypeptide
VDAKYAKEEKHAWIEIHALPNLTIDQMAAFISKLFDDPSQSSELLSEAKKLNDSQAPK

SEQ ID NO: 1212 - protein, 58 aa, ARTIFICIAL SEQUENCE
  Engineered IL6 binding polypeptide
VDAKYAKEEKYAWHEIHILPNLTVDQVAAFITKLFDDPSQSSELLSEAKKLNDSQAPK

SEQ ID NO: 1213 - protein, 58 aa, ARTIFICIAL SEQUENCE
  Engineered IL6 binding polypeptide
VDAKYAKEEKDAWHEIHILPNLTVDQMAAFITKLFDDPSQSSELLSEAKKLNDSQAPK

SEQ ID NO: 1214 - protein, 58 aa, ARTIFICIAL SEQUENCE
  Engineered IL6 binding polypeptide
VDAKYAKEEYHAWMEIHILPNLTIEQIAAFITKLFDDPSQSSELLSEAKKLNDSQAPK

SEQ ID NO: 1215 - protein, 58 aa, ARTIFICIAL SEQUENCE
  Engineered IL6 binding polypeptide
VDAKYAKEEYRAWHEIHILPNLTIQQMAAFITKLFDDPSQSSELLSEAKKLNDSQAPK

SEQ ID NO: 1216 - protein, 58 aa, ARTIFICIAL SEQUENCE
  Engineered IL6 binding polypeptide
VDAKYAKEEKFAWHEIHILPNLTVQQMAAFITKLFDDPSQSSELLSEAKKLNDSQAPK

SEQ ID NO: 1217 - protein, 58 aa, ARTIFICIAL SEQUENCE
  Engineered IL6 binding polypeptide
VDAKYAKEEKHAWTEIHLLPNLTVNQMAAFISKLFDDPSQSSELLSEAKKLNDSQAPK

SEQ ID NO: 1218 - protein, 58 aa, ARTIFICIAL SEQUENCE
  Engineered IL6 binding polypeptide
VDAKYAKEEEFAWREIHILPNLTISQIAAFITKLFDDPSQSSELLSEAKKLNDSQAPK

SEQ ID NO: 1219 - protein, 58 aa, ARTIFICIAL SEQUENCE
  Engineered IL6 binding polypeptide
VDAKYAKEEKMAWKEIHVLPNLTVDQMAAFITKLFDDPSQSSELLSEAKKLNDSQAPK

SEQ ID NO: 1220 - protein, 58 aa, ARTIFICIAL SEQUENCE
  Engineered IL6 binding polypeptide
VDAKYAKEEYAAWHEIHVLPNLTIGQMAAFITKLFDDPSQSSELLSEAKKLNDSQAPK

SEQ ID NO: 1221 - protein, 58 aa, ARTIFICIAL SEQUENCE
  Engineered IL6 binding polypeptide
VDAKYAKEEQYAWQEIHKLPNLTVEQMAAFITKLFDDPSQSSELLSEAKKLNDSQAPK

SEQ ID NO: 1222 - protein, 58 aa, ARTIFICIAL SEQUENCE
  Engineered IL6 binding polypeptide
VDAKYAKEEWEAWNEIHSLPNLTIDQIAAFITKLFDDPSQSSELLSEAKKLNDSQAPK

SEQ ID NO: 1223 - protein, 58 aa, ARTIFICIAL SEQUENCE
  Engineered IL6 binding polypeptide
VDAKYAKEEKMAWKEIHLLPNLTVEQMAAFITKLFDDPSQSSELLSEAKKLNDSQAPK

SEQ ID NO: 1224 - protein, 58 aa, ARTIFICIAL SEQUENCE
  Engineered IL6 binding polypeptide
VDAKYAKEEAHAWREIHNLPNLTIEQMAAFISKLFDDPSQSSELLSEAKKLNDSQAPK

SEQ ID NO: 1225 - protein, 58 aa, ARTIFICIAL SEQUENCE
  Engineered IL6 binding polypeptide
VDAKYAKEERRAWTEIHILPNLTVDQIAAFISKLFDDPSQSSELLSEAKKLNDSQAPK

SEQ ID NO: 1226 - protein, 58 aa, ARTIFICIAL SEQUENCE
  Engineered IL6 binding polypeptide
VDAKYAKEEYEAWMEIHLLPNLTINQIAAFITKLFDDPSQSSELLSEAKKLNDSQAPK

SEQ ID NO: 1227 - protein, 58 aa, ARTIFICIAL SEQUENCE
  Engineered IL6 binding polypeptide
VDAKYAKEEKHAWMEIHALPNLTIDQMAAFITKLFDDPSQSSELLSEAKKLNDSQAPK

SEQ ID NO: 1228 - protein, 58 aa, ARTIFICIAL SEQUENCE
  Engineered IL6 binding polypeptide
VDAKYAKEEHQAWHEIHILPNLTIQQMAAFITKLFDDPSQSSELLSEAKKLNDSQAPK

SEQ ID NO: 1229 - protein, 58 aa, ARTIFICIAL SEQUENCE
  Engineered IL6 binding polypeptide
VDAKYAKEEYYAWREIHLLPNLTVDQMAAFITKLFDDPSQSSELLSEAKKLNDSQAPK

SEQ ID NO: 1230 - protein, 58 aa, ARTIFICIAL SEQUENCE
  Engineered IL6 binding polypeptide
VDAKYAKEEQEAWMEIHKLPNLTIDQVAAFITKLFDDPSQSSELLSEAKKLNDSQAPK

SEQ ID NO: 1231 - protein, 58 aa, ARTIFICIAL SEQUENCE
  Engineered IL6 binding polypeptide
VDAKYAKEEAHAWTEIHSLPNLTVDQMAAFITKLFDDPSQSSELLSEAKKLNDSQAPK

SEQ ID NO: 1232 - protein, 58 aa, ARTIFICIAL SEQUENCE
  Engineered IL6 binding polypeptide
VDAKYAKEEKLAWKEIHLLPNLTISQMAAFITKLFDDPSQSSELLSEAKKLNDSQAPK

SEQ ID NO: 1233 - protein, 58 aa, ARTIFICIAL SEQUENCE
  Engineered IL6 binding polypeptide
VDAKYAKEEYDAWTEIHKLPNLTVDQMAAFISKLFDDPSQSSELLSEAKKLNDSQAPK

SEQ ID NO: 1234 - protein, 58 aa, ARTIFICIAL SEQUENCE
  Engineered IL6 binding polypeptide
VDAKYAKEEARAWMEIHNLPNLTVDQMAAFITKLFDDPSQSSELLSEAKKLNDSQAPK

SEQ ID NO: 1235 - protein, 58 aa, ARTIFICIAL SEQUENCE
  Engineered IL6 binding polypeptide
VDAKYAKEEYRAWTEIHLLPNLTVHQMAAFITKLFDDPSQSSELLSEAKKLNDSQAPK

SEQ ID NO: 1236 - protein, 58 aa, ARTIFICIAL SEQUENCE
  Engineered IL6 binding polypeptide
VDAKYAKEEYHAWYEIHILPNLTVEQIAAFITKLFDDPSQSSELLSEAKKLNDSQAPK

SEQ ID NO: 1237 - protein, 58 aa, ARTIFICIAL SEQUENCE
  Engineered IL6 binding polypeptide
VDAKYAKEESDAWKEIHLLPNLTIEQMAAFISKLFDDPSQSSELLSEAKKLNDSQAPK

SEQ ID NO: 1238 - protein, 58 aa, ARTIFICIAL SEQUENCE
  Engineered IL6 binding polypeptide
VDAKYAKEEAYAWREIHILPNLTVDQMAAFISKLFDDPSQSSELLSEAKKLNDSQAPK

SEQ ID NO: 1239 - protein, 58 aa, ARTIFICIAL SEQUENCE
  Engineered IL6 binding polypeptide
VDAKYAKEEAAAWNEIHRLPNLTIDQMAAFISKLFDDPSQSSELLSEAKKLNDSQAPK

SEQ ID NO: 1240 - protein, 58 aa, ARTIFICIAL SEQUENCE
  Engineered IL6 binding polypeptide
VDAKYAKEEYHAWWEIHKLPNLTVNQMAAFITKLFDDPSQSSELLSEAKKLNDSQAPK

SEQ ID NO: 1241 - protein, 58 aa, ARTIFICIAL SEQUENCE
  Engineered IL6 binding polypeptide
VDAKYAKEEKAAWYEIHKLPNLTIDQMAAFITKLFDDPSQSSELLSEAKKLNDSQAPK

SEQ ID NO: 1242 - protein, 58 aa, ARTIFICIAL SEQUENCE
  Engineered IL6 binding polypeptide
VDAKYAKEEKEAWTEIHLLPNLTVDQIAAFITKLFDDPSQSSELLSEAKKLNDSQAPK

SEQ ID NO: 1243 - protein, 58 aa, ARTIFICIAL SEQUENCE
  Engineered IL6 binding polypeptide
VDAKYAKEEKRAWYEIHGLPNLTISQMAAFISKLFDDPSQSSELLSEAKKLNDSQAPK

SEQ ID NO: 1244 - protein, 58 aa, ARTIFICIAL SEQUENCE
  Engineered IL6 binding polypeptide
VDAKYAKEEARAWYEIHILPNLTVHQMAAFITKLFDDPSQSSELLSEAKKLNDSQAPK

SEQ ID NO: 1245 - protein, 58 aa, ARTIFICIAL SEQUENCE
  Engineered IL6 binding polypeptide
VDAKYAKEEKTAWVEIHKLPNLTINQMAAFITKLFDDPSQSSELLSEAKKLNDSQAPK

SEQ ID NO: 1246 - protein, 58 aa, ARTIFICIAL SEQUENCE
  Engineered IL6 binding polypeptide
VDAKYAKEERDAWFEIHILPNLTVEQMAAFITKLFDDPSQSSELLSEAKKLNDSQAPK

SEQ ID NO: 1247 - protein, 58 aa, ARTIFICIAL SEQUENCE
  Engineered IL6 binding polypeptide
VDAKYAKEEAMAWKEIHGLPNLTIEQMAAFISKLFDDPSQSSELLSEAKKLNDSQAPK

SEQ ID NO: 1248 - protein, 58 aa, ARTIFICIAL SEQUENCE
  Engineered IL6 binding polypeptide
VDAKYAKEEQYAWREIHILPNLTVHQVAAFISKLFDDPSQSSELLSEAKKLNDSQAPK

SEQ ID NO: 1249 - protein, 58 aa, ARTIFICIAL SEQUENCE
  Engineered IL6 binding polypeptide
VDAKYAKEEWEAWIEIHNLPNLTVGQMAAFITKLFDDPSQSSELLSEAKKLNDSQAPK

SEQ ID NO: 1250 - protein, 58 aa, ARTIFICIAL SEQUENCE
  Engineered IL6 binding polypeptide
VDAKYAKEEYAAWTEIHTLPNLTVDQVAAFISKLFDDPSQSSELLSEAKKLNDSQAPK

SEQ ID NO: 1251 - protein, 58 aa, ARTIFICIAL SEQUENCE
  Engineered IL6 binding polypeptide
VDAKYAKEEEDAWHEIHLLPNLTIEQMAAFITKLFDDPSQSSELLSEAKKLNDSQAPK

SEQ ID NO: 1252 - protein, 58 aa, ARTIFICIAL SEQUENCE
  Engineered IL6 binding polypeptide
VDAKYAKEERNAWYEIHALPNLTVEQMAAFITKLFDDPSQSSELLSEAKKLNDSQAPK

SEQ ID NO: 1253 - protein, 58 aa, ARTIFICIAL SEQUENCE
  Engineered IL6 binding polypeptide
VDAKYAKEEKRAWYEIHILPNLTVEQIAAFITKLFDDPSQSSELLSEAKKLNDSQAPK

SEQ ID NO: 1254 - protein, 58 aa, ARTIFICIAL SEQUENCE
  Engineered IL6 binding polypeptide
VDAKYAKEEYQAWIEIHILPNLTISQMAAFITKLFDDPSQSSELLSEAKKLNDSQAPK

SEQ ID NO: 1255 - protein, 58 aa, ARTIFICIAL SEQUENCE
  Engineered IL6 binding polypeptide
VDAKYAKEEKRAWYEIHLLPNLTIGQMAAFITKLFDDPSQSSELLSEAKKLNDSQAPK

SEQ ID NO: 1256 - protein, 58 aa, ARTIFICIAL SEQUENCE
  Engineered IL6 binding polypeptide
VDAKYAKEEYLAWLEIHNLPNLTVDQMAAFITKLFDDPSQSSELLSEAKKLNDSQAPK

SEQ ID NO: 1257 - protein, 58 aa, ARTIFICIAL SEQUENCE
  Engineered IL6 binding polypeptide
VDAKYAKEEYFAWYEIHNLPNLTVDQMAAFITKLFDDPSQSSELLSEAKKLNDSQAPK

SEQ ID NO: 1258 - protein, 58 aa, ARTIFICIAL SEQUENCE
  Engineered IL6 binding polypeptide
VDAKYAKEEAFAWWEIHKLPNLTVEQMAAFITKLFDDPSQSSELLSEAKKLNDSQAPK

SEQ ID NO: 1259 - protein, 58 aa, ARTIFICIAL SEQUENCE
  Engineered IL6 binding polypeptide
VDAKYAKEESIAWQEIHKLPNLTIEQMAAFITKLFDDPSQSSELLSEAKKLNDSQAPK

SEQ ID NO: 1260 - protein, 58 aa, ARTIFICIAL SEQUENCE
  Engineered IL6 binding polypeptide
VDAKYAKEEWDAWNEIHLLPNLTINQMAAFITKLFDDPSQSSELLSEAKKLNDSQAPK

SEQ ID NO: 1261 - protein, 58 aa, ARTIFICIAL SEQUENCE
  Engineered IL6 binding polypeptide
VDAKYAKEEAYAWNEIHRLPNLTVEQMAAFITKLFDDPSQSSELLSEAKKLNDSQAPK

SEQ ID NO: 1262 - protein, 58 aa, ARTIFICIAL SEQUENCE
  Engineered IL6 binding polypeptide
VDAKYAKEEAEAWFEIHKLPNLTVGQMAAFITKLFDDPSQSSELLSEAKKLNDSQAPK

SEQ ID NO: 1263 - protein, 58 aa, ARTIFICIAL SEQUENCE
  Engineered IL6 binding polypeptide
VDAKYAKEEREAWHEIHILPNLTVEQVAAFITKLFDDPSQSSELLSEAKKLNDSQAPK

SEQ ID NO: 1264 - protein, 58 aa, ARTIFICIAL SEQUENCE
  Engineered IL6 binding polypeptide
VDAKYAKEEHDAWMEIHLLPNLTIEQMAAFITKLFDDPSQSSELLSEAKKLNDSQAPK

SEQ ID NO: 1265 - protein, 58 aa, ARTIFICIAL SEQUENCE
  Engineered IL6 binding polypeptide
VDAKYAKEEYSAWIEIHLLPNLTVSQMAAFITKLFDDPSQSSELLSEAKKLNDSQAPK

SEQ ID NO: 1266 - protein, 58 aa, ARTIFICIAL SEQUENCE
  Engineered IL6 binding polypeptide
VDAKYAKEEYDAWYEIHTLPNLTVDQVAAFITKLFDDPSQSSELLSEAKKLNDSQAPK

SEQ ID NO: 1267 - protein, 58 aa, ARTIFICIAL SEQUENCE
  Engineered IL6 binding polypeptide
VDAKYAKEEKMAWTEIHNLPNLTIDQMAAFITKLFDDPSQSSELLSEAKKLNDSQAPK

SEQ ID NO: 1268 - protein, 58 aa, ARTIFICIAL SEQUENCE
  Engineered IL6 binding polypeptide
VDAKYAKEEYAAWFEIHSLPNLTVEQMAAFITKLFDDPSQSSELLSEAKKLNDSQAPK

SEQ ID NO: 1269 - protein, 58 aa, ARTIFICIAL SEQUENCE
  Engineered IL6 binding polypeptide
VDAKYAKEERRAWDEIHRLPNLTIEQMAAFITKLFDDPSQSSELLSEAKKLNDSQAPK

SEQ ID NO: 1270 - protein, 58 aa, ARTIFICIAL SEQUENCE
  Engineered IL6 binding polypeptide
VDAKYAKEEYDAWLEIHLLPNLTIEQMAAFITKLFDDPSQSSELLSEAKKLNDSQAPK

SEQ ID NO: 1271 - protein, 58 aa, ARTIFICIAL SEQUENCE
  Engineered IL6 binding polypeptide
VDAKYAKEEYDAWNEIHTLPNLTIDQMAAFITKLFDDPSQSSELLSEAKKLNDSQAPK

SEQ ID NO: 1272 - protein, 58 aa, ARTIFICIAL SEQUENCE
  Engineered IL6 binding polypeptide
VDAKYAKEERVAWNEIHKLPNLTIDQMAAFITKLFDDPSQSSELLSEAKKLNDSQAPK

SEQ ID NO: 1273 - protein, 58 aa, ARTIFICIAL SEQUENCE
  Engineered IL6 binding polypeptide
VDAKYAKEEAHAWTEIHKLPNLTVDQMAAFITKLFDDPSQSSELLSEAKKLNDSQAPK

SEQ ID NO: 1274 - protein, 58 aa, ARTIFICIAL SEQUENCE
  Engineered IL6 binding polypeptide
VDAKYAKEEYRAWMEIHLLPNLTIDQMAAFITKLFDDPSQSSELLSEAKKLNDSQAPK

SEQ ID NO: 1275 - protein, 58 aa, ARTIFICIAL SEQUENCE
  Engineered IL6 binding polypeptide
VDAKYAKEESAAWTEIHLLPNLTIEQMAAFITKLFDDPSQSSELLSEAKKLNDSQAPK

SEQ ID NO: 1276 - protein, 58 aa, ARTIFICIAL SEQUENCE
  Engineered IL6 binding polypeptide
VDAKYAKEEYFAWTEIHVLPNLTVKQIAAFITKLFDDPSQSSELLSEAKKLNDSQAPK

SEQ ID NO: 1277 - protein, 58 aa, ARTIFICIAL SEQUENCE
  Engineered IL6 binding polypeptide
VDAKYAKEEFHAWSEIHLLPNLTVSQMAAFISKLFDDPSQSSELLSEAKKLNDSQAPK

SEQ ID NO: 1278 - protein, 58 aa, ARTIFICIAL SEQUENCE
  Engineered IL6 binding polypeptide
VDAKYAKEEYDAWTEIHALPNLTVDQVAAFITKLFDDPSQSSELLSEAKKLNDSQAPK

SEQ ID NO: 1279 - protein, 58 aa, ARTIFICIAL SEQUENCE
  Engineered IL6 binding polypeptide
VDAKYAKEEKAAWFEIHNLPNLTISQMAAFITKLFDDPSQSSELLSEAKKLNDSQAPK

SEQ ID NO: 1280 - protein, 58 aa, ARTIFICIAL SEQUENCE
  Engineered IL6 binding polypeptide
VDAKYAKEEYQAWIEIHALPNLTIEQMAAFITKLFDDPSQSSELLSEAKKLNDSQAPK

SEQ ID NO: 1281 - protein, 58 aa, ARTIFICIAL SEQUENCE
  Engineered IL6 binding polypeptide
VDAKYAKEEYDAWVEIHKLPNLTINQMAAFITKLFDDPSQSSELLSEAKKLNDSQAPK

SEQ ID NO: 1282 - protein, 58 aa, ARTIFICIAL SEQUENCE
  Engineered IL6 binding polypeptide
VDAKYAKEEQSAWMEIHILPNLTVSQIAAFISKLFDDPSQSSELLSEAKKLNDSQAPK

SEQ ID NO: 1283 - protein, 58 aa, ARTIFICIAL SEQUENCE
  Engineered IL6 binding polypeptide
VDAKYAKEERAAWNEIHSLPNLTVEQMAAFITKLFDDPSQSSELLSEAKKLNDSQAPK

SEQ ID NO: 1284 - protein, 58 aa, ARTIFICIAL SEQUENCE
  Engineered IL6 binding polypeptide
VDAKYAKEEHEAWNEIHKLPNLTIDQMAAFITKLFDDPSQSSELLSEAKKLNDSQAPK

SEQ ID NO: 1285 - protein, 58 aa, ARTIFICIAL SEQUENCE
  Engineered IL6 binding polypeptide
VDAKYAKEERFAWWEIHRLPNLTVRQVAAFISKLFDDPSQSSELLSEAKKLNDSQAPK

SEQ ID NO: 1286 - protein, 58 aa, ARTIFICIAL SEQUENCE
  Engineered IL6 binding polypeptide
VDAKYAKEEFEAWYEIHILPNLTVEQMAAFITKLFDDPSQSSELLSEAKKLNDSQAPK

SEQ ID NO: 1287 - protein, 58 aa, ARTIFICIAL SEQUENCE
  Engineered IL6 binding polypeptide
VDAKYAKEEKDAWNEIHRLPNLTVDQVAAFITKLFDDPSQSSELLSEAKKLNDSQAPK

SEQ ID NO: 1288 - protein, 58 aa, ARTIFICIAL SEQUENCE
  Engineered IL6 binding polypeptide
VDAKYAKEEARAWYEIHVLPNLTVHQIAAFITKLFDDPSQSSELLSEAKKLNDSQAPK

SEQ ID NO: 1289 - protein, 58 aa, ARTIFICIAL SEQUENCE
  Engineered IL6 binding polypeptide
VDAKYAKEERRAWNEIHKLPNLTVEQMAAFITKLFDDPSQSSELLSEAKKLNDSQAPK

SEQ ID NO: 1290 - protein, 58 aa, ARTIFICIAL SEQUENCE
  Engineered IL6 binding polypeptide
VDAKYAKEEYMAWDEIHRLPNLTVEQMAAFITKLFDDPSQSSELLSEAKKLNDSQAPK

SEQ ID NO: 1291 - protein, 58 aa, ARTIFICIAL SEQUENCE
  Engineered IL6 binding polypeptide
VDAKYAKEERNAWFEIHALPNLTIDQMAAFITKLFDDPSQSSELLSEAKKLNDSQAPK

SEQ ID NO: 1292 - protein, 58 aa, ARTIFICIAL SEQUENCE
  Engineered IL6 binding polypeptide
VDAKYAKEEAEAWQEIHLLPNLTVGQMAAFISKLFDDPSQSSELLSEAKKLNDSQAPK

SEQ ID NO: 1293 - protein, 58 aa, ARTIFICIAL SEQUENCE
  Engineered IL6 binding polypeptide
VDAKYAKEEKNAWYEIHLLPNLTIQQMAAFISKLFDDPSQSSELLSEAKKLNDSQAPK

SEQ ID NO: 1294 - protein, 58 aa, ARTIFICIAL SEQUENCE
  Engineered IL6 binding polypeptide
VDAKYAKEEAIAWHEIHLLPNLTITQMAAFITKLFDDPSQSSELLSEAKKLNDSQAPK

SEQ ID NO: 1295 - protein, 58 aa, ARTIFICIAL SEQUENCE
  Engineered IL6 binding polypeptide
VDAKYAKEEKDAWEEIHRLPNLTVTQMAAFISKLFDDPSQSSELLSEAKKLNDSQAPK

SEQ ID NO: 1296 - protein, 58 aa, ARTIFICIAL SEQUENCE
  Engineered IL6 binding polypeptide
VDAKYAKEEYDAWFEIHLLPNLTVQQIAAFITKLFDDPSQSSELLSEAKKLNDSQAPK

SEQ ID NO: 1297 - protein, 58 aa, ARTIFICIAL SEQUENCE
  Engineered IL6 binding polypeptide
VDAKYAKEEAAAWMEIHLLPNLTVEQMAAFITKLFDDPSQSSELLSEAKKLNDSQAPK

SEQ ID NO: 1298 - protein, 58 aa, ARTIFICIAL SEQUENCE
  Engineered IL6 binding polypeptide
VDAKYAKEERKAWNEIHQLPNLTIQQVAAFITKLFDDPSQSSELLSEAKKLNDSQAPK

SEQ ID NO: 1299 - protein, 58 aa, ARTIFICIAL SEQUENCE
  Engineered IL6 binding polypeptide
VDAKYAKEEYAAWWEIHALPNLTVEQVAAFITKLFDDPSQSSELLSEAKKLNDSQAPK

SEQ ID NO: 1300 - protein, 58 aa, ARTIFICIAL SEQUENCE
  Engineered IL6 binding polypeptide
VDAKYAKEEKEAWMEIHILPNLTIDQMAAFITKLFDDPSQSSELLSEAKKLNDSQAPK

SEQ ID NO: 1301 - protein, 58 aa, ARTIFICIAL SEQUENCE
  Engineered IL6 binding polypeptide
VDAKYAKEEKIAWKEIHLLPNLTISQMAAFITKLFDDPSQSSELLSEAKKLNDSQAPK

SEQ ID NO: 1302 - protein, 58 aa, ARTIFICIAL SEQUENCE
  Engineered IL6 binding polypeptide
VDAKYAKEEHAAWMEIHLLPNLTVDQMAAFITKLFDDPSQSSELLSEAKKLNDSQAPK

SEQ ID NO: 1303 - protein, 58 aa, ARTIFICIAL SEQUENCE
  Engineered IL6 binding polypeptide
VDAKYAKEEKDAWYEIHILPNLTVDQMAAFITKLFDDPSQSSELLSEAKKLNDSQAPK

SEQ ID NO: 1304 - protein, 58 aa, ARTIFICIAL SEQUENCE
  Engineered IL6 binding polypeptide
VDAKYAKEERAAWNEIHKLPNLTIEQMAAFITKLFDDPSQSSELLSEAKKLNDSQAPK

SEQ ID NO: 1305 - protein, 58 aa, ARTIFICIAL SEQUENCE
  Engineered IL6 binding polypeptide
VDAKYAKEEAAAWFEIHILPNLTVGQIAAFITKLFDDPSQSSELLSEAKKLNDSQAPK

SEQ ID NO: 1306 - protein, 58 aa, ARTIFICIAL SEQUENCE
  Engineered IL6 binding polypeptide
VDAKYAKEEKFAWTEIHNLPNLTVDQMAAFITKLFDDPSQSSELLSEAKKLNDSQAPK

SEQ ID NO: 1307 - protein, 58 aa, ARTIFICIAL SEQUENCE
  Engineered IL6 binding polypeptide
VDAKYAKEEWLAWNEIHLLPNLTVDQMAAFITKLFDDPSQSSELLSEAKKLNDSQAPK

SEQ ID NO: 1308 - protein, 58 aa, ARTIFICIAL SEQUENCE
  Engineered IL6 binding polypeptide
VDAKYAKEEQRAWREIHILPNLTIDQMAAFITKLFDDPSQSSELLSEAKKLNDSQAPK

SEQ ID NO: 1309 - protein, 58 aa, ARTIFICIAL SEQUENCE
  Engineered IL6 binding polypeptide
VDAKYAKEEFQAWREIHLLPNLTIEQMAAFITKLFDDPSQSSELLSEAKKLNDSQAPK

SEQ ID NO: 1310 - protein, 58 aa, ARTIFICIAL SEQUENCE
  Engineered IL6 binding polypeptide
VDAKYAKEERMAWHEIHILPNLTVSQVAAFITKLFDDPSQSSELLSEAKKLNDSQAPK

SEQ ID NO: 1311 - protein, 58 aa, ARTIFICIAL SEQUENCE
  Engineered IL6 binding polypeptide
VDAKYAKEEKKAWYEIHILPNLTVNQIAAFITKLFDDPSQSSELLSEAKKLNDSQAPK

SEQ ID NO: 1312 - protein, 58 aa, ARTIFICIAL SEQUENCE
  Engineered IL6 binding polypeptide
VDAKYAKEEYYAWNEIHKLPNLTVIQVAAFITKLFDDPSQSSELLSEAKKLNDSQAPK

SEQ ID NO: 1313 - protein, 58 aa, ARTIFICIAL SEQUENCE
  Engineered IL6 binding polypeptide
VDAKYAKEEADAWREIHLLPNLTLEQMAAFITKLFDDPSQSSELLSEAKKLNDSQAPK

SEQ ID NO: 1314 - protein, 58 aa, ARTIFICIAL SEQUENCE
  Engineered IL6 binding polypeptide
VDAKYAKEEYEAWNEIHRLPNLTIDQMAAFISKLFDDPSQSSELLSEAKKLNDSQAPK

SEQ ID NO: 1315 - protein, 58 aa, ARTIFICIAL SEQUENCE
  Engineered IL6 binding polypeptide
VDAKYAKEEKKAWWEIHALPNLTVNQVAAFISKLFDDPSQSSELLSEAKKLNDSQAPK

SEQ ID NO: 1316 - protein, 58 aa, ARTIFICIAL SEQUENCE
  Engineered IL6 binding polypeptide
VDAKYAKEEKTAWREIHLLPNLTIEQMAAFITKLFDDPSQSSELLSEAKKLNDSQAPK

SEQ ID NO: 1317 - protein, 58 aa, ARTIFICIAL SEQUENCE
  Engineered IL6 binding polypeptide
VDAKYAKEEKDAWYEIHLLPNLTVDQIAAFITKLFDDPSQSSELLSEAKKLNDSQAPK

SEQ ID NO: 1318 - protein, 58 aa, ARTIFICIAL SEQUENCE
  Engineered IL6 binding polypeptide
VDAKYAKEEYTAWYEIHILPNLTIKQMAAFISKLFDDPSQSSELLSEAKKLNDSQAPK

SEQ ID NO: 1319 - protein, 58 aa, ARTIFICIAL SEQUENCE
  Engineered IL6 binding polypeptide
VDAKYAKEEYHAWYEIHLLPNLTIEQIAAFITKLFDDPSQSSELLSEAKKLNDSQAPK

SEQ ID NO: 1320 - protein, 58 aa, ARTIFICIAL SEQUENCE
  Engineered IL6 binding polypeptide
VDAKYAKEEAHAWREIHLLPNLTVLQMAAFITKLFDDPSQSSELLSEAKKLNDSQAPK

SEQ ID NO: 1321 - protein, 58 aa, ARTIFICIAL SEQUENCE
  Engineered IL6 binding polypeptide
VDAKYAKEEYEAWNEIHKLPNLTIDQMAAFITKLFDDPSQSSELLSEAKKLNDSQAPK

SEQ ID NO: 1322 - protein, 58 aa, ARTIFICIAL SEQUENCE
  Engineered IL6 binding polypeptide
VDAKYAKEERAAWNEIHALPNLTIDQMAAFITKLFDDPSQSSELLSEAKKLNDSQAPK

SEQ ID NO: 1323 - protein, 58 aa, ARTIFICIAL SEQUENCE
  Engineered IL6 binding polypeptide
VDAKYAKEEFDAWVEIHLLPNLTIDQMAAFITKLFDDPSQSSELLSEAKKLNDSQAPK

SEQ ID NO: 1324 - protein, 58 aa, ARTIFICIAL SEQUENCE
  Engineered IL6 binding polypeptide
VDAKYAKEEKAAWKEIHILPNLTVDQMAAFITKLFDDPSQSSELLSEAKKLNDSQAPK

SEQ ID NO: 1325 - protein, 58 aa, ARTIFICIAL SEQUENCE
  Engineered IL6 binding polypeptide
VDAKYAKEEWDAWLEIHALPNLTVDQVAAFISKLFDDPSQSSELLSEAKKLNDSQAPK

SEQ ID NO: 1326 - protein, 58 aa, ARTIFICIAL SEQUENCE
  Engineered IL6 binding polypeptide
VDAKYAKEEYNAWYEIHSLPNLTVEQMAAFITKLFDDPSQSSELLSEAKKLNDSQAPK

SEQ ID NO: 1327 - protein, 58 aa, ARTIFICIAL SEQUENCE
  Engineered IL6 binding polypeptide
VDAKYAKEEWNAWNEIHKLPNLTVEQMAAFITKLFDDPSQSSELLSEAKKLNDSQAPK

SEQ ID NO: 1328 - protein, 58 aa, ARTIFICIAL SEQUENCE
  Engineered IL6 binding polypeptide
VDAKYAKEEKEAWFEIHILPNLTVEQIAAFISKLFDDPSQSSELLSEAKKLNDSQAPK

SEQ ID NO: 1329 - protein, 58 aa, ARTIFICIAL SEQUENCE
  Engineered IL6 binding polypeptide
VDAKYAKEEATAWWEIHKLPNLTVQQVAAFISKLFDDPSQSSELLSEAKKLNDSQAPK

SEQ ID NO: 1330 - protein, 58 aa, ARTIFICIAL SEQUENCE
  Engineered IL6 binding polypeptide
VDAKYAKEEYEAWYEIHILPNLTVGQIAAFITKLFDDPSQSSELLSEAKKLNDSQAPK

SEQ ID NO: 1331 - protein, 58 aa, ARTIFICIAL SEQUENCE
  Engineered IL6 binding polypeptide
VDAKYAKEEANAWKEIHLLPNLTVGQVAAFITKLFDDPSQSSELLSEAKKLNDSQAPK

SEQ ID NO: 1332 - protein, 58 aa, ARTIFICIAL SEQUENCE
  Engineered IL6 binding polypeptide
VDAKYAKEEKRAWHEIHVLPNLTVEQIAAFITKLFDDPSQSSELLSEAKKLNDSQAPK

SEQ ID NO: 1333 - protein, 58 aa, ARTIFICIAL SEQUENCE
  Engineered IL6 binding polypeptide
VDAKYAKEEYDAWVEIHLLPNLTIDQIAAFITKLFDDPSQSSELLSEAKKLNDSQAPK

SEQ ID NO: 1334 - protein, 58 aa, ARTIFICIAL SEQUENCE
  Engineered IL6 binding polypeptide
VDAKYAKEEAEAWFEIHILPNLTINQIAAFITKLFDDPSQSSELLSEAKKLNDSQAPK

SEQ ID NO: 1335 - protein, 58 aa, ARTIFICIAL SEQUENCE
  Engineered IL6 binding polypeptide
VDAKYAKEEWHAWNEIHKLPNLTIDQMAAFITKLFDDPSQSSELLSEAKKLNDSQAPK

SEQ ID NO: 1336 - protein, 58 aa, ARTIFICIAL SEQUENCE
  Engineered IL6 binding polypeptide
VDAKYAKEEYEAWFEIHILPNLTVDQIAAFITKLFDDPSQSSELLSEAKKLNDSQAPK

SEQ ID NO: 1337 - protein, 58 aa, ARTIFICIAL SEQUENCE
  Engineered IL6 binding polypeptide
VDAKYAKEEYEAWREIHLLPNLTVSQMAAFITKLFDDPSQSSELLSEAKKLNDSQAPK

SEQ ID NO: 1338 - protein, 58 aa, ARTIFICIAL SEQUENCE
  Engineered IL6 binding polypeptide
VDAKYAKEERAAWFEIHILPNLTISQMAAFITKLFDDPSQSSELLSEAKKLNDSQAPK

SEQ ID NO: 1339 - protein, 58 aa, ARTIFICIAL SEQUENCE
  Engineered IL6 binding polypeptide
VDAKYAKEEAQAWKEIHLLPNLTIEQMAAFISKLFDDPSQSSELLSEAKKLNDSQAPK

SEQ ID NO: 1340 - protein, 58 aa, ARTIFICIAL SEQUENCE
  Engineered IL6 binding polypeptide
VDAKYAKEEKAAWFEIHILPNLTIHQMAAFITKLFDDPSQSSELLSEAKKLNDSQAPK

SEQ ID NO: 1341 - protein, 58 aa, ARTIFICIAL SEQUENCE
  Engineered IL6 binding polypeptide
VDAKYAKEEYEAWIEIHNLPNLTIEQMAAFITKLFDDPSQSSELLSEAKKLNDSQAPK

SEQ ID NO: 1342 - protein, 58 aa, ARTIFICIAL SEQUENCE
  Engineered IL6 binding polypeptide
VDAKYAKEEKYAWVEIHKLPNLTVEQVAAFITKLFDDPSQSSELLSEAKKLNDSQAPK

SEQ ID NO: 1343 - protein, 58 aa, ARTIFICIAL SEQUENCE
  Engineered IL6 binding polypeptide
VDAKYAKEEYHAWWEIHLLPNLTVEQMAAFITKLFDDPSQSSELLSEAKKLNDSQAPK

SEQ ID NO: 1344 - protein, 58 aa, ARTIFICIAL SEQUENCE
  Engineered IL6 binding polypeptide
VDAKYAKEEKAAWNEIHLLPNLTIDQIAAFITKLFDDPSQSSELLSEAKKLNDSQAPK

SEQ ID NO: 1345 - protein, 58 aa, ARTIFICIAL SEQUENCE
  Engineered IL6 binding polypeptide
VDAKYAKEEYRAWIEIHLLPNLTVEQMAAFISKLFDDPSQSSELLSEAKKLNDSQAPK

SEQ ID NO: 1346 - protein, 58 aa, ARTIFICIAL SEQUENCE
  Engineered IL6 binding polypeptide
VDAKYAKEEHDAWFEIHLLPNLTIEQMAAFITKLFDDPSQSSELLSEAKKLNDSQAPK

SEQ ID NO: 1347 - protein, 58 aa, ARTIFICIAL SEQUENCE
  Engineered IL6 binding polypeptide
VDAKYAKEERNAWMEIHLLPNLTVEQMAAFITKLFDDPSQSSELLSEAKKLNDSQAPK

SEQ ID NO: 1348 - protein, 58 aa, ARTIFICIAL SEQUENCE
  Engineered IL6 binding polypeptide
VDAKYAKEEKHAWYEIHVLPNLTVDQMAAFITKLFDDPSQSSELLSEAKKLNDSQAPK

SEQ ID NO: 1349 - protein, 58 aa, ARTIFICIAL SEQUENCE
  Engineered IL6 binding polypeptide
VDAKYAKEEHDAWYEIHILPNLTIHQMAAFITKLFDDPSQSSELLSEAKKLNDSQAPK

SEQ ID NO: 1350 - protein, 58 aa, ARTIFICIAL SEQUENCE
  Engineered IL6 binding polypeptide
VDAKYAKEEKEAWYEIHLLPNLTVNQMAAFITKLFDDPSQSSELLSEAKKLNDSQAPK

SEQ ID NO: 1351 - protein, 58 aa, ARTIFICIAL SEQUENCE
  Engineered IL6 binding polypeptide
VDAKYAKEEAAAWMEIHLLPNLTVGQMAAFITKLFDDPSQSSELLSEAKKLNDSQAPK

SEQ ID NO: 1352 - protein, 58 aa, ARTIFICIAL SEQUENCE
  Engineered IL6 binding polypeptide
VDAKYAKEEAYAWREIHLLPNLTVDQMAAFITKLFDDPSQSSELLSEAKKLNDSQAPK

SEQ ID NO: 1353 - protein, 58 aa, ARTIFICIAL SEQUENCE
  Engineered IL6 binding polypeptide
VDAKYAKEEYQAWTEIHTLPNLTVDQMAAFITKLFDDPSQSSELLSEAKKLNDSQAPK

SEQ ID NO: 1354 - protein, 58 aa, ARTIFICIAL SEQUENCE
  Engineered IL6 binding polypeptide
VDAKYAKEEKDAWYEIHLLPNLTVDQMAAFITKLFDDPSQSSELLSEAKKLNDSQAPK

SEQ ID NO: 1355 - protein, 58 aa, ARTIFICIAL SEQUENCE
  Engineered IL6 binding polypeptide
VDAKYAKEEANAWWEIHLLPNLTVEQMAAFITKLFDDPSQSSELLSEAKKLNDSQAPK

SEQ ID NO: 1356 - protein, 58 aa, ARTIFICIAL SEQUENCE
  Engineered IL6 binding polypeptide
VDAKYAKEEAKAWHEIHILPNLTITQMAAFITKLFDDPSQSSELLSEAKKLNDSQAPK

SEQ ID NO: 1357 - protein, 58 aa, ARTIFICIAL SEQUENCE
  Engineered IL6 binding polypeptide
VDAKYAKEEWSAWVEIHSLPNLTVSQIAAFITKLFDDPSQSSELLSEAKKLNDSQAPK

SEQ ID NO: 1358 - protein, 58 aa, ARTIFICIAL SEQUENCE
  Engineered IL6 binding polypeptide
VDAKYAKEERRAWYEIHILPNLTVEQMAAFITKLFDDPSQSSELLSEAKKLNDSQAPK

SEQ ID NO: 1359 - protein, 58 aa, ARTIFICIAL SEQUENCE
  Engineered IL6 binding polypeptide
VDAKYAKEEKDAWFEIHVLPNLTVDQMAAFITKLFDDPSQSSELLSEAKKLNDSQAPK

SEQ ID NO: 1360 - protein, 58 aa, ARTIFICIAL SEQUENCE
  Engineered IL6 binding polypeptide
VDAKYAKEEKRAWLEIHNLPNLTIDQMAAFISKLFDDPSQSSELLSEAKKLNDSQAPK

SEQ ID NO: 1361 - protein, 58 aa, ARTIFICIAL SEQUENCE
  Engineered IL6 binding polypeptide
VDAKYAKEEHGAWTEIHLLPNLTIEQVAAFITKLFDDPSQSSELLSEAKKLNDSQAPK

SEQ ID NO: 1362 - protein, 58 aa, ARTIFICIAL SEQUENCE
  Engineered IL6 binding polypeptide
VDAKYAKEERKAWIEIHLLPNLTIEQMAAFITKLFDDPSQSSELLSEAKKLNDSQAPK

SEQ ID NO: 1363 - protein, 58 aa, ARTIFICIAL SEQUENCE
  Engineered IL6 binding polypeptide
VDAKYAKEERSAWTEIHLLPNLTIDQMAAFITKLFDDPSQSSELLSEAKKLNDSQAPK

SEQ ID NO: 1364 - protein, 58 aa, ARTIFICIAL SEQUENCE
  Engineered IL6 binding polypeptide
VDAKYAKEELKAWTEIHNLPNLTIDQMAAFITKLFDDPSQSSELLSEAKKLNDSQAPK

SEQ ID NO: 1365 - protein, 58 aa, ARTIFICIAL SEQUENCE
  Engineered IL6 binding polypeptide
VDAKYAKEEANAWYEIHILPNLTVDQVAAFITKLFDDPSQSSELLSEAKKLNDSQAPK

SEQ ID NO: 1366 - protein, 58 aa, ARTIFICIAL SEQUENCE
  Engineered IL6 binding polypeptide
VDAKYAKEEWQAWWEIHALPNLTVEQVAAFITKLFDDPSQSSELLSEAKKLNDSQAPK

SEQ ID NO: 1367 - protein, 58 aa, ARTIFICIAL SEQUENCE
  Engineered IL6 binding polypeptide
VDAKYAKEEYNAWLEIHSLPNLTVTQMAAFITKLFDDPSQSSELLSEAKKLNDSQAPK

SEQ ID NO: 1368 - protein, 58 aa, ARTIFICIAL SEQUENCE
  Engineered IL6 binding polypeptide
VDAKYAKEEKKAWTEIHTLPNLTVEQMAAFITKLFDDPSQSSELLSEAKKLNDSQAPK

SEQ ID NO: 1369 - protein, 58 aa, ARTIFICIAL SEQUENCE
  Engineered IL6 binding polypeptide
VDAKYAKEEKAAWYEIHLLPNLTVVQMAAFITKLFDDPSQSSELLSEAKKLNDSQAPK

SEQ ID NO: 1370 - protein, 58 aa, ARTIFICIAL SEQUENCE
  Engineered IL6 binding polypeptide
VDAKYAKEEKAAWREIHLLPNLTINQMAAFITKLFDDPSQSSELLSEAKKLNDSQAPK

SEQ ID NO: 1371 - protein, 58 aa, ARTIFICIAL SEQUENCE
  Engineered IL6 binding polypeptide
VDAKYAKEEFEAWVEIHLLPNLTIEQIAAFITKLFDDPSQSSELLSEAKKLNDSQAPK

SEQ ID NO: 1372 - protein, 58 aa, ARTIFICIAL SEQUENCE
  Engineered IL6 binding polypeptide
VDAKYAKEEYAAWVEIHNLPNLTVEQMAAFITKLFDDPSQSSELLSEAKKLNDSQAPK

SEQ ID NO: 1373 - protein, 58 aa, ARTIFICIAL SEQUENCE
  Engineered IL6 binding polypeptide
VDAKYAKEESDAWYEIHTLPNLTINQMAAFISKLFDDPSQSSELLSEAKKLNDSQAPK

SEQ ID NO: 1374 - protein, 58 aa, ARTIFICIAL SEQUENCE
  Engineered IL6 binding polypeptide
VDAKYAKEEKFAWTEIHILPNLTVDQMAAFITKLFDDPSQSSELLSEAKKLNDSQAPK

SEQ ID NO: 1375 - protein, 58 aa, ARTIFICIAL SEQUENCE
  Engineered IL6 binding polypeptide
VDAKYAKEEAEAWWEIHILPNLTVSQIAAFISKLFDDPSQSSELLSEAKKLNDSQAPK

SEQ ID NO: 1376 - protein, 58 aa, ARTIFICIAL SEQUENCE
  Engineered IL6 binding polypeptide
VDAKYAKEEYQAWFEIHLLPNLTINQMAAFISKLFDDPSQSSELLSEAKKLNDSQAPK

SEQ ID NO: 1377 - protein, 58 aa, ARTIFICIAL SEQUENCE
  Engineered IL6 binding polypeptide
VDAKYAKEEAKAWTEIHTLPNLTVDQMAAFITKLFDDPSQSSELLSEAKKLNDSQAPK

SEQ ID NO: 1378 - protein, 58 aa, ARTIFICIAL SEQUENCE
  Engineered IL6 binding polypeptide
VDAKYAKEEQLAWTEIHKLPNLTIDQMAAFITKLFDDPSQSSELLSEAKKLNDSQAPK

SEQ ID NO: 1379 - protein, 58 aa, ARTIFICIAL SEQUENCE
  Engineered IL6 binding polypeptide
VDAKYAKEEYDAWTEIHLLPNLTIEQMAAFITKLFDDPSQSSELLSEAKKLNDSQAPK

SEQ ID NO: 1380 - protein, 58 aa, ARTIFICIAL SEQUENCE
  Engineered IL6 binding polypeptide
VDAKYAKEEWDAWVEIHTLPNLTVDQMAAFITKLFDDPSQSSELLSEAKKLNDSQAPK

SEQ ID NO: 1381 - protein, 58 aa, ARTIFICIAL SEQUENCE
  Engineered IL6 binding polypeptide
VDAKYAKEEFEAWHEIHILPNLTVQQMAAFITKLFDDPSQSSELLSEAKKLNDSQAPK

SEQ ID NO: 1382 - protein, 58 aa, ARTIFICIAL SEQUENCE
  Engineered IL6 binding polypeptide
VDAKYAKEEWEAWVEIHNLPNLTIDQMAAFITKLFDDPSQSSELLSEAKKLNDSQAPK

SEQ ID NO: 1383 - protein, 58 aa, ARTIFICIAL SEQUENCE
  Engineered IL6 binding polypeptide
VDAKYAKEERAAWWEIHGLPNLTVDQMAAFITKLFDDPSQSSELLSEAKKLNDSQAPK

SEQ ID NO: 1384 - protein, 58 aa, ARTIFICIAL SEQUENCE
  Engineered IL6 binding polypeptide
VDAKYAKEERDAWHEIHRLPNLTIEQMAAFISKLFDDPSQSSELLSEAKKLNDSQAPK

SEQ ID NO: 1385 - protein, 58 aa, ARTIFICIAL SEQUENCE
  Engineered IL6 binding polypeptide
VDAKYAKEEKTAWTEIHILPNLTIHQMAAFISKLFDDPSQSSELLSEAKKLNDSQAPK

SEQ ID NO: 1386 - protein, 58 aa, ARTIFICIAL SEQUENCE
  Engineered IL6 binding polypeptide
VDAKYAKEEFDAWMEIHLLPNLTINQMAAFITKLFDDPSQSSELLSEAKKLNDSQAPK

SEQ ID NO: 1387 - protein, 58 aa, ARTIFICIAL SEQUENCE
  Engineered IL6 binding polypeptide
VDAKYAKEEHLAWVEIHNLPNLTVEQMAAFITKLFDDPSQSSELLSEAKKLNDSQAPK

SEQ ID NO: 1388 - protein, 58 aa, ARTIFICIAL SEQUENCE
  Engineered IL6 binding polypeptide
VDAKYAKEERHAWWEIHKLPNLTIEQMAAFITKLFDDPSQSSELLSEAKKLNDSQAPK

SEQ ID NO: 1389 - protein, 58 aa, ARTIFICIAL SEQUENCE
  Engineered IL6 binding polypeptide
VDAKYAKEEYDAWFEIHLLPNLTVEQMAAFITKLFDDPSQSSELLSEAKKLNDSQAPK

SEQ ID NO: 1390 - protein, 58 aa, ARTIFICIAL SEQUENCE
  Engineered IL6 binding polypeptide
VDAKYAKEEKWAWTEIHLLPNLTIEQMAAFISKLFDDPSQSSELLSEAKKLNDSQAPK

SEQ ID NO: 1391 - protein, 58 aa, ARTIFICIAL SEQUENCE
  Engineered IL6 binding polypeptide
VDAKYAKEEAKAWFEIHILPNLTIEQIAAFITKLFDDPSQSSELLSEAKKLNDSQAPK

SEQ ID NO: 1392 - protein, 58 aa, ARTIFICIAL SEQUENCE
  Engineered IL6 binding polypeptide
VDAKYAKEEYRAWTEIHLLPNLTIHQMAAFITKLFDDPSQSSELLSEAKKLNDSQAPK

SEQ ID NO: 1393 - protein, 58 aa, ARTIFICIAL SEQUENCE
  Engineered IL6 binding polypeptide
VDAKYAKEEKHAWTEIHILPNLTVEQMAAFITKLFDDPSQSSELLSEAKKLNDSQAPK

SEQ ID NO: 1394 - protein, 58 aa, ARTIFICIAL SEQUENCE
  Engineered IL6 binding polypeptide
VDAKYAKEEARAWTEIHTLPNLTIDQIAAFITKLFDDPSQSSELLSEAKKLNDSQAPK

SEQ ID NO: 1395 - protein, 58 aa, ARTIFICIAL SEQUENCE
  Engineered IL6 binding polypeptide
VDAKYAKEEYAAWVEIHSLPNLTVDQMAAFITKLFDDPSQSSELLSEAKKLNDSQAPK

SEQ ID NO: 1396 - protein, 58 aa, ARTIFICIAL SEQUENCE
  Engineered IL6 binding polypeptide
VDAKYAKEEYDAWYEIHLLPNLTINQMAAFITKLFDDPSQSSELLSEAKKLNDSQAPK

SEQ ID NO: 1397 - protein, 58 aa, ARTIFICIAL SEQUENCE
  Engineered IL6 binding polypeptide
VDAKYAKEEFNAWNEIHLLPNLTVTQMAAFITKLFDDPSQSSELLSEAKKLNDSQAPK

SEQ ID NO: 1398 - protein, 58 aa, ARTIFICIAL SEQUENCE
  Engineered IL6 binding polypeptide
VDAKYAKEEKAAWNEIHLLPNLTIDQMAAFISKLFDDPSQSSELLSEAKKLNDSQAPK

SEQ ID NO: 1399 - protein, 58 aa, ARTIFICIAL SEQUENCE
  Engineered IL6 binding polypeptide
VDAKYAKEERIAWFEIHILPNLTIKQMAAFISKLFDDPSQSSELLSEAKKLNDSQAPK

SEQ ID NO: 1400 - protein, 58 aa, ARTIFICIAL SEQUENCE
  Engineered IL6 binding polypeptide
VDAKYAKEEYKAWYEIHILPNLTVQQMAAFITKLFDDPSQSSELLSEAKKLNDSQAPK

SEQ ID NO: 1401 - protein, 58 aa, ARTIFICIAL SEQUENCE
  Engineered IL6 binding polypeptide
VDAKYAKEEQHAWYEIHILPNLTIDQMAAFITKLFDDPSQSSELLSEAKKLNDSQAPK

SEQ ID NO: 1402 - protein, 58 aa, ARTIFICIAL SEQUENCE
  Engineered IL6 binding polypeptide
VDAKYAKEERYAWFEIHALPNLTVSQMAAFITKLFDDPSQSSELLSEAKKLNDSQAPK

SEQ ID NO: 1403 - protein, 58 aa, ARTIFICIAL SEQUENCE
  Engineered IL6 binding polypeptide
VDAKYAKEEYKAWIEIHLLPNLTIDQIAAFISKLFDDPSQSSELLSEAKKLNDSQAPK

SEQ ID NO: 1404 - protein, 58 aa, ARTIFICIAL SEQUENCE
  Engineered IL6 binding polypeptide
VDAKYAKEERTAWFEIHLLPNLTVDQIAAFITKLFDDPSQSSELLSEAKKLNDSQAPK

SEQ ID NO: 1405 - protein, 58 aa, ARTIFICIAL SEQUENCE
  Engineered IL6 binding polypeptide
VDAKYAKEEKHAWWEIHKLPNLTINQMAAFITKLFDDPSQSSELLSEAKKLNDSQAPK

SEQ ID NO: 1406 - protein, 58 aa, ARTIFICIAL SEQUENCE
  Engineered IL6 binding polypeptide
VDAKYAKEEKMAWFEIHVLPNLTISQIAAFITKLFDDPSQSSELLSEAKKLNDSQAPK

SEQ ID NO: 1407 - protein, 58 aa, ARTIFICIAL SEQUENCE
  Engineered IL6 binding polypeptide
VDAKYAKEEFDAWTEIHLLPNLTVDQMAAFISKLFDDPSQSSELLSEAKKLNDSQAPK

SEQ ID NO: 1408 - protein, 58 aa, ARTIFICIAL SEQUENCE
  Engineered IL6 binding polypeptide
VDAKYAKEERDAWFEIHRLPNLTVSQMAAFITKLFDDPSQSSELLSEAKKLNDSQAPK

SEQ ID NO: 1409 - protein, 58 aa, ARTIFICIAL SEQUENCE
  Engineered IL6 binding polypeptide
VDAKYAKEEAVAWTEIHLLPNLTIDQMAAFITKLFDDPSQSSELLSEAKKLNDSQAPK

SEQ ID NO: 1410 - protein, 58 aa, ARTIFICIAL SEQUENCE
  Engineered IL6 binding polypeptide
VDAKYAKEEWYAWREIHILPNLTVEQVAAFITKLFDDPSQSSELLSEAKKLNDSQAPK

SEQ ID NO: 1411 - protein, 58 aa, ARTIFICIAL SEQUENCE
  Engineered IL6 binding polypeptide
VDAKYAKEEFHAWYEIHILPNLTVDQMAAFITKLFDDPSQSSELLSEAKKLNDSQAPK

SEQ ID NO: 1412 - protein, 58 aa, ARTIFICIAL SEQUENCE
  Engineered IL6 binding polypeptide
VDAKYAKEEYEAWTEIHLLPNLTIDQMAAFITKLFDDPSQSSELLSEAKKLNDSQAPK

SEQ ID NO: 1413 - protein, 58 aa, ARTIFICIAL SEQUENCE
  Engineered IL6 binding polypeptide
VDAKYAKEEWDAWTEIHALPNLTIDQMAAFITKLFDDPSQSSELLSEAKKLNDSQAPK

SEQ ID NO: 1414 - protein, 58 aa, ARTIFICIAL SEQUENCE
  Engineered IL6 binding polypeptide
VDAKYAKEESEAWTEIHLLPNLTIDQMAAFITKLFDDPSQSSELLSEAKKLNDSQAPK

SEQ ID NO: 1415 - protein, 58 aa, ARTIFICIAL SEQUENCE
  Engineered IL6 binding polypeptide
VDAKYAKEEFTAWSEIHNLPNLTVEQMAAFITKLFDDPSQSSELLSEAKKLNDSQAPK

SEQ ID NO: 1416 - protein, 58 aa, ARTIFICIAL SEQUENCE
  Engineered IL6 binding polypeptide
VDAKYAKEEADAWHEIHILPNLTVEQMAAFITKLFDDPSQSSELLSEAKKLNDSQAPK

SEQ ID NO: 1417 - protein, 58 aa, ARTIFICIAL SEQUENCE
  Engineered IL6 binding polypeptide
VDAKYAKEEKAAWFEIHILPNLTVDQMAAFITKLFDDPSQSSELLSEAKKLNDSQAPK

SEQ ID NO: 1418 - protein, 58 aa, ARTIFICIAL SEQUENCE
  Engineered IL6 binding polypeptide
VDAKYAKEERRAWHEIHILPNLTVEQMAAFISKLFDDPSQSSELLSEAKKLNDSQAPK

SEQ ID NO: 1419 - protein, 58 aa, ARTIFICIAL SEQUENCE
  Engineered IL6 binding polypeptide
VDAKYAKEERDAWWEIHKLPNLTVDQMAAFITKLFDDPSQSSELLSEAKKLNDSQAPK

SEQ ID NO: 1420 - protein, 58 aa, ARTIFICIAL SEQUENCE
  Engineered IL6 binding polypeptide
VDAKYAKEEAYAWKEIHILPNLTIDQMAAFISKLFDDPSQSSELLSEAKKLNDSQAPK

SEQ ID NO: 1421 - protein, 58 aa, ARTIFICIAL SEQUENCE
  Engineered IL6 binding polypeptide
VDAKYAKEERAAWTEIHNLPNLTIDQMAAFITKLFDDPSQSSELLSEAKKLNDSQAPK

SEQ ID NO: 1422 - protein, 58 aa, ARTIFICIAL SEQUENCE
  Engineered IL6 binding polypeptide
VDAKYAKEEYAAWTEIHKLPNLTIDQMAAFITKLFDDPSQSSELLSEAKKLNDSQAPK

SEQ ID NO: 1423 - protein, 58 aa, ARTIFICIAL SEQUENCE
  Engineered IL6 binding polypeptide
VDAKYAKEERTAWMEIHGLPNLTIEQMAAFISKLFDDPSQSSELLSEAKKLNDSQAPK

SEQ ID NO: 1424 - protein, 58 aa, ARTIFICIAL SEQUENCE
  Engineered IL6 binding polypeptide
VDAKYAKEEWTAWNEIHLLPNLTIEQMAAFITKLFDDPSQSSELLSEAKKLNDSQAPK

SEQ ID NO: 1425 - protein, 58 aa, ARTIFICIAL SEQUENCE
  Engineered IL6 binding polypeptide
VDAKYAKEEKDAWFEIHILPNLTVHQIAAFISKLFDDPSQSSELLSEAKKLNDSQAPK

SEQ ID NO: 1426 - protein, 58 aa, ARTIFICIAL SEQUENCE
  Engineered IL6 binding polypeptide
VDAKYAKEEKSAWREIHLLPNLTIEQMAAFISKLFDDPSQSSELLSEAKKLNDSQAPK

SEQ ID NO: 1427 - protein, 58 aa, ARTIFICIAL SEQUENCE
  Engineered IL6 binding polypeptide
VDAKYAKEEYTAWLEIHALPNLTITQMAAFITKLFDDPSQSSELLSEAKKLNDSQAPK

SEQ ID NO: 1428 - protein, 58 aa, ARTIFICIAL SEQUENCE
  Engineered IL6 binding polypeptide
VDAKYAKEEKMAWMEIHKLPNLTIDQMAAFITKLFDDPSQSSELLSEAKKLNDSQAPK

SEQ ID NO: 1429 - protein, 58 aa, ARTIFICIAL SEQUENCE
  Engineered IL6 binding polypeptide
VDAKYAKEEYHAWYEIHLLPNLTVEQIAAFITKLFDDPSQSSELLSEAKKLNDSQAPK

SEQ ID NO: 1430 - protein, 58 aa, ARTIFICIAL SEQUENCE
  Engineered IL6 binding polypeptide
VDAKYAKEEKDAWFEIHALPNLTVDQMAAFISKLFDDPSQSSELLSEAKKLNDSQAPK

SEQ ID NO: 1431 - protein, 58 aa, ARTIFICIAL SEQUENCE
  Engineered IL6 binding polypeptide
VDAKYAKEERAAWFEIHLLPNLTVEQMAAFITKLFDDPSQSSELLSEAKKLNDSQAPK

SEQ ID NO: 1432 - protein, 58 aa, ARTIFICIAL SEQUENCE
  Engineered IL6 binding polypeptide
VDAKYAKEEYMAWLEIHNLPNLTVEQMAAFITKLFDDPSQSSELLSEAKKLNDSQAPK

SEQ ID NO: 1433 - protein, 58 aa, ARTIFICIAL SEQUENCE
  Engineered IL6 binding polypeptide
VDAKYAKEEYIAWREIHLLPNLTIDQMAAFITKLFDDPSQSSELLSEAKKLNDSQAPK

SEQ ID NO: 1434 - protein, 58 aa, ARTIFICIAL SEQUENCE
  Engineered IL6 binding polypeptide
VDAKYAKEEKAAWHEIHVLPNLTISQMAAFITKLFDDPSQSSELLSEAKKLNDSQAPK

SEQ ID NO: 1435 - protein, 58 aa, ARTIFICIAL SEQUENCE
  Engineered IL6 binding polypeptide
VDAKYAKEEWQAWNEIHLLPNLTIDQMAAFISKLFDDPSQSSELLSEAKKLNDSQAPK

SEQ ID NO: 1436 - protein, 58 aa, ARTIFICIAL SEQUENCE
  Engineered IL6 binding polypeptide
VDAKYAKEEWEAWFEIHLLPNLTISQMAAFITKLFDDPSQSSELLSEAKKLNDSQAPK

SEQ ID NO: 1437 - protein, 58 aa, ARTIFICIAL SEQUENCE
  Engineered IL6 binding polypeptide
VDAKYAKEEYHAWWEIHKLPNLTISQMAAFITKLFDDPSQSSELLSEAKKLNDSQAPK

SEQ ID NO: 1438 - protein, 58 aa, ARTIFICIAL SEQUENCE
  Engineered IL6 binding polypeptide
VDAKYAKEEYAAWVEIHALPNLTVEQMAAFITKLFDDPSQSSELLSEAKKLNDSQAPK

SEQ ID NO: 1439 - protein, 58 aa, ARTIFICIAL SEQUENCE
  Engineered IL6 binding polypeptide
VDAKYAKEERMAWHEIHILPNLTVQQMAAFISKLFDDPSQSSELLSEAKKLNDSQAPK

SEQ ID NO: 1440 - protein, 58 aa, ARTIFICIAL SEQUENCE
  Engineered IL6 binding polypeptide
VDAKYAKEERDAWYEIHNLPNLTIDQMAAFISKLFDDPSQSSELLSEAKKLNDSQAPK

SEQ ID NO: 1441 - protein, 58 aa, ARTIFICIAL SEQUENCE
  Engineered IL6 binding polypeptide
VDAKYAKEESYAWWEIHKLPNLTVEQMAAFISKLFDDPSQSSELLSEAKKLNDSQAPK

SEQ ID NO: 1442 - protein, 58 aa, ARTIFICIAL SEQUENCE
  Engineered IL6 binding polypeptide
VDAKYAKEEKRAWKEIHILPNLTINQMAAFITKLFDDPSQSSELLSEAKKLNDSQAPK

SEQ ID NO: 1443 - protein, 58 aa, ARTIFICIAL SEQUENCE
  Engineered IL6 binding polypeptide
VDAKYAKEEKEAWFEIHALPNLTVEQIAAFITKLFDDPSQSSELLSEAKKLNDSQAPK

SEQ ID NO: 1444 - protein, 58 aa, ARTIFICIAL SEQUENCE
  Engineered IL6 binding polypeptide
VDAKYAKEEYEAWNEIHKLPNLTVSQMAAFISKLFDDPSQSSELLSEAKKLNDSQAPK

SEQ ID NO: 1445 - protein, 58 aa, ARTIFICIAL SEQUENCE
  Engineered IL6 binding polypeptide
VDAKYAKEEAAAWMEIHLLPNLTIDQMAAFITKLFDDPSQSSELLSEAKKLNDSQAPK

SEQ ID NO: 1446 - protein, 58 aa, ARTIFICIAL SEQUENCE
  Engineered IL6 binding polypeptide
VDAKYAKEERNAWEEIHLLPNLTINQIAAFITKLFDDPSQSSELLSEAKKLNDSQAPK

SEQ ID NO: 1447 - protein, 58 aa, ARTIFICIAL SEQUENCE
  Engineered IL6 binding polypeptide
VDAKYAKEEAYAWHEIHILPNLTVDQMAAFITKLFDDPSQSSELLSEAKKLNDSQAPK

SEQ ID NO: 1448 - protein, 58 aa, ARTIFICIAL SEQUENCE
  Engineered IL6 binding polypeptide
VDAKYAKEEANAWFEIHVLPNLTVEQMAAFITKLFDDPSQSSELLSEAKKLNDSQAPK

SEQ ID NO: 1449 - protein, 58 aa, ARTIFICIAL SEQUENCE
  Engineered IL6 binding polypeptide
VDAKYAKEEKNAWTEIHKLPNLTVDQMAAFITKLFDDPSQSSELLSEAKKLNDSQAPK

SEQ ID NO: 1450 - protein, 58 aa, ARTIFICIAL SEQUENCE
  Engineered IL6 binding polypeptide
VDAKYAKEEYDAWYEIHLLPNLTISQMAAFISKLFDDPSQSSELLSEAKKLNDSQAPK

SEQ ID NO: 1451 - protein, 58 aa, ARTIFICIAL SEQUENCE
  Engineered IL6 binding polypeptide
VDAKYAKEERLAWAEIHKLPNLTIEQVAAFISKLFDDPSQSSELLSEAKKLNDSQAPK

SEQ ID NO: 1452 - protein, 58 aa, ARTIFICIAL SEQUENCE
  Engineered IL6 binding polypeptide
VDAKYAKEERAAWNEIHILPNLTVQQMAAFITKLFDDPSQSSELLSEAKKLNDSQAPK

SEQ ID NO: 1453 - protein, 58 aa, ARTIFICIAL SEQUENCE
  Engineered IL6 binding polypeptide
VDAKYAKEEAAAWDEIHRLPNLTVDQIAAFITKLFDDPSQSSELLSEAKKLNDSQAPK

SEQ ID NO: 1454 - protein, 58 aa, ARTIFICIAL SEQUENCE
  Engineered IL6 binding polypeptide
VDAKYAKEEKEAWWEIHGLPNLTVNQMAAFITKLFDDPSQSSELLSEAKKLNDSQAPK

SEQ ID NO: 1455 - protein, 58 aa, ARTIFICIAL SEQUENCE
  Engineered IL6 binding polypeptide
VDAKYAKEERKAWYEIHTLPNLTINQMAAFITKLFDDPSQSSELLSEAKKLNDSQAPK

SEQ ID NO: 1456 - protein, 58 aa, ARTIFICIAL SEQUENCE
  Engineered IL6 binding polypeptide
VDAKYAKEERNAWYEIHILPNLTIEQMAAFITKLFDDPSQSSELLSEAKKLNDSQAPK

SEQ ID NO: 1457 - protein, 58 aa, ARTIFICIAL SEQUENCE
  Engineered IL6 binding polypeptide
VDAKYAKEEKLAWMEIHLLPNLTIEQMAAFITKLFDDPSQSSELLSEAKKLNDSQAPK

SEQ ID NO: 1458 - protein, 58 aa, ARTIFICIAL SEQUENCE
  Engineered IL6 binding polypeptide
VDAKYAKEEYMAWLEIHNLPNLTVDQMAAFITKLFDDPSQSSELLSEAKKLNDSQAPK

SEQ ID NO: 1459 - protein, 58 aa, ARTIFICIAL SEQUENCE
  Engineered IL6 binding polypeptide
VDAKYAKEESDAWREIHLLPNLTIEQMAAFISKLFDDPSQSSELLSEAKKLNDSQAPK

SEQ ID NO: 1460 - protein, 58 aa, ARTIFICIAL SEQUENCE
  Engineered IL6 binding polypeptide
VDAKYAKEEKEAWYEIHQLPNLTVNQMAAFISKLFDDPSQSSELLSEAKKLNDSQAPK

SEQ ID NO: 1461 - protein, 58 aa, ARTIFICIAL SEQUENCE
  Engineered IL6 binding polypeptide
VDAKYAKEEKQAWYEIHNLPNLTINQMAAFITKLFDDPSQSSELLSEAKKLNDSQAPK

SEQ ID NO: 1462 - protein, 58 aa, ARTIFICIAL SEQUENCE
  Engineered IL6 binding polypeptide
VDAKYAKEEYEAWTEIHRLPNLTIDQMAAFITKLFDDPSQSSELLSEAKKLNDSQAPK

SEQ ID NO: 1463 - protein, 58 aa, ARTIFICIAL SEQUENCE
  Engineered IL6 binding polypeptide
VDAKYAKEEKDAWYEIHVLPNLTISQMAAFITKLFDDPSQSSELLSEAKKLNDSQAPK

SEQ ID NO: 1464 - protein, 58 aa, ARTIFICIAL SEQUENCE
  Engineered IL6 binding polypeptide
VDAKYAKEERIAWYEIHILPNLTISQMAAFITKLFDDPSQSSELLSEAKKLNDSQAPK

SEQ ID NO: 1465 - protein, 58 aa, ARTIFICIAL SEQUENCE
  Engineered IL6 binding polypeptide
VDAKYAKEEQYAWTEIHKLPNLTIDQMAAFITKLFDDPSQSSELLSEAKKLNDSQAPK

SEQ ID NO: 1466 - protein, 58 aa, ARTIFICIAL SEQUENCE
  Engineered IL6 binding polypeptide
VDAKYAKEESDAWWEIHKLPNLTIDQMAAFITKLFDDPSQSSELLSEAKKLNDSQAPK

SEQ ID NO: 1467 - protein, 58 aa, ARTIFICIAL SEQUENCE
  Engineered IL6 binding polypeptide
VDAKYAKEEKFAWNEIHLLPNLTIEQMAAFITKLFDDPSQSSELLSEAKKLNDSQAPK

SEQ ID NO: 1468 - protein, 58 aa, ARTIFICIAL SEQUENCE
  Engineered IL6 binding polypeptide
VDAKYAKEERAAWYEIHLLPNLTVNQIAAFITKLFDDPSQSSELLSEAKKLNDSQAPK

SEQ ID NO: 1469 - protein, 58 aa, ARTIFICIAL SEQUENCE
  Engineered IL6 binding polypeptide
VDAKYAKEEFHAWWEIHKLPNLTVEQVAAFITKLFDDPSQSSELLSEAKKLNDSQAPK

SEQ ID NO: 1470 - protein, 58 aa, ARTIFICIAL SEQUENCE
  Engineered IL6 binding polypeptide
VDAKYAKEEKQAWLEIHILPNLTVGQIAAFITKLFDDPSQSSELLSEAKKLNDSQAPK

SEQ ID NO: 1471 - protein, 58 aa, ARTIFICIAL SEQUENCE
  Engineered IL6 binding polypeptide
VDAKYAKEEHLAWTEIHLLPNLTINQMAAFITKLFDDPSQSSELLSEAKKLNDSQAPK

SEQ ID NO: 1472 - protein, 58 aa, ARTIFICIAL SEQUENCE
  Engineered IL6 binding polypeptide
VDAKYAKEEATAWREIHLLPNLTINQMAAFITKLFDDPSQSSELLSEAKKLNDSQAPK

SEQ ID NO: 1473 - protein, 58 aa, ARTIFICIAL SEQUENCE
  Engineered IL6 binding polypeptide
VDAKYAKEEKRAWYEIHILPNLTVEQVAAFITKLFDDPSQSSELLSEAKKLNDSQAPK

SEQ ID NO: 1474 - protein, 58 aa, ARTIFICIAL SEQUENCE
  Engineered IL6 binding polypeptide
VDAKYAKEEYEAWTEIHLLPNLTVSQMAAFITKLFDDPSQSSELLSEAKKLNDSQAPK

SEQ ID NO: 1475 - protein, 58 aa, ARTIFICIAL SEQUENCE
  Engineered IL6 binding polypeptide
VDAKYAKEESNAWWEIHKLPNLTVNQVAAFITKLFDDPSQSSELLSEAKKLNDSQAPK

SEQ ID NO: 1476 - protein, 58 aa, ARTIFICIAL SEQUENCE
  Engineered IL6 binding polypeptide
VDAKYAKEEKRAWMEIHLLPNLTVDQIAAFITKLFDDPSQSSELLSEAKKLNDSQAPK

SEQ ID NO: 1477 - protein, 58 aa, ARTIFICIAL SEQUENCE
  Engineered IL6 binding polypeptide
VDAKYAKEEKFAWKEIHILPNLTVDQIAAFITKLFDDPSQSSELLSEAKKLNDSQAPK

SEQ ID NO: 1478 - protein, 58 aa, ARTIFICIAL SEQUENCE
  Engineered IL6 binding polypeptide
VDAKYAKEERDAWFEIHVLPNLTILQMAAFITKLFDDPSQSSELLSEAKKLNDSQAPK

SEQ ID NO: 1479 - protein, 58 aa, ARTIFICIAL SEQUENCE
  Engineered IL6 binding polypeptide
VDAKYAKEEHYAWTEIHILPNLTVNQMAAFITKLFDDPSQSSELLSEAKKLNDSQAPK

SEQ ID NO: 1480 - protein, 58 aa, ARTIFICIAL SEQUENCE
  Engineered IL6 binding polypeptide
VDAKYAKEEKRAWMEIHLLPNLTVHQMAAFITKLFDDPSQSSELLSEAKKLNDSQAPK

SEQ ID NO: 1481 - protein, 58 aa, ARTIFICIAL SEQUENCE
  Engineered IL6 binding polypeptide
VDAKYAKEEYDAWVEIHLLPNLTVEQMAAFITKLFDDPSQSSELLSEAKKLNDSQAPK

SEQ ID NO: 1482 - protein, 58 aa, ARTIFICIAL SEQUENCE
  Engineered IL6 binding polypeptide
VDAKYAKEEHTAWFEIHILPNLTISQIAAFITKLFDDPSQSSELLSEAKKLNDSQAPK

SEQ ID NO: 1483 - protein, 58 aa, ARTIFICIAL SEQUENCE
  Engineered IL6 binding polypeptide
VDAKYAKEELQAWKEIHILPNLTVDQIAAFITKLFDDPSQSSELLSEAKKLNDSQAPK

SEQ ID NO: 1484 - protein, 58 aa, ARTIFICIAL SEQUENCE
  Engineered IL6 binding polypeptide
VDAKYAKEEYDAWLEIHLLPNLTISQMAAFITKLFDDPSQSSELLSEAKKLNDSQAPK

SEQ ID NO: 1485 - protein, 58 aa, ARTIFICIAL SEQUENCE
  Engineered IL6 binding polypeptide
VDAKYAKEEARAWREIHILPNLTVEQMAAFITKLFDDPSQSSELLSEAKKLNDSQAPK

SEQ ID NO: 1486 - protein, 58 aa, ARTIFICIAL SEQUENCE
  Engineered IL6 binding polypeptide
VDAKYAKEERNAWFEIHILPNLTIDQMAAFITKLFDDPSQSSELLSEAKKLNDSQAPK

SEQ ID NO: 1487 - protein, 58 aa, ARTIFICIAL SEQUENCE
  Engineered IL6 binding polypeptide
VDAKYAKEEAYAWHEIHVLPNLTIDQMAAFITKLFDDPSQSSELLSEAKKLNDSQAPK

SEQ ID NO: 1488 - protein, 58 aa, ARTIFICIAL SEQUENCE
  Engineered IL6 binding polypeptide
VDAKYAKEEYFAWTEIHKLPNLTINQMAAFITKLFDDPSQSSELLSEAKKLNDSQAPK

SEQ ID NO: 1489 - protein, 58 aa, ARTIFICIAL SEQUENCE
  Engineered IL6 binding polypeptide
VDAKYAKEEAGAWYEIHLLPNLTVEQMAAFITKLFDDPSQSSELLSEAKKLNDSQAPK

SEQ ID NO: 1490 - protein, 58 aa, ARTIFICIAL SEQUENCE
  Engineered IL6 binding polypeptide
VDAKYAKEEKKAWYEIHILPNLTIEQMAAFISKLFDDPSQSSELLSEAKKLNDSQAPK

SEQ ID NO: 1491 - protein, 58 aa, ARTIFICIAL SEQUENCE
  Engineered IL6 binding polypeptide
VDAKYAKEEKQAWFEIHLLPNLTIEQMAAFISKLFDDPSQSSELLSEAKKLNDSQAPK

SEQ ID NO: 1492 - protein, 58 aa, ARTIFICIAL SEQUENCE
  Engineered IL6 binding polypeptide
VDAKYAKEEWHAWLEIHNLPNLTIEQMAAFISKLFDDPSQSSELLSEAKKLNDSQAPK

SEQ ID NO: 1493 - protein, 58 aa, ARTIFICIAL SEQUENCE
  Engineered IL6 binding polypeptide
VDAKYAKEEKSAWIEIHNLPNLTINQMAAFITKLFDDPSQSSELLSEAKKLNDSQAPK

SEQ ID NO: 1494 - protein, 58 aa, ARTIFICIAL SEQUENCE
  Engineered IL6 binding polypeptide
VDAKYAKEEYQAWNEIHILPNLTINQIAAFITKLFDDPSQSSELLSEAKKLNDSQAPK

SEQ ID NO: 1495 - protein, 58 aa, ARTIFICIAL SEQUENCE
  Engineered IL6 binding polypeptide
VDAKYAKEEAYAWVEIHKLPNLTVTQVAAFISKLFDDPSQSSELLSEAKKLNDSQAPK

SEQ ID NO: 1496 - protein, 58 aa, ARTIFICIAL SEQUENCE
  Engineered IL6 binding polypeptide
VDAKYAKEEYDAWMEIHNLPNLTIEQMAAFITKLFDDPSQSSELLSEAKKLNDSQAPK

SEQ ID NO: 1497 - protein, 58 aa, ARTIFICIAL SEQUENCE
  Engineered IL6 binding polypeptide
VDAKYAKEEYEAWVEIHNLPNLTIEQMAAFITKLFDDPSQSSELLSEAKKLNDSQAPK

SEQ ID NO: 1498 - protein, 58 aa, ARTIFICIAL SEQUENCE
  Engineered IL6 binding polypeptide
VDAKYAKEEREAWNEIHLLPNLTIEQIAAFITKLFDDPSQSSELLSEAKKLNDSQAPK

SEQ ID NO: 1499 - protein, 58 aa, ARTIFICIAL SEQUENCE
  Engineered IL6 binding polypeptide
VDAKYAKEEKRAWYEIHILPNLTVGQMAAFISKLFDDPSQSSELLSEAKKLNDSQAPK

SEQ ID NO: 1500 - protein, 58 aa, ARTIFICIAL SEQUENCE
  Engineered IL6 binding polypeptide
VDAKYAKEEKEAWTEIHILPNLTVEQMAAFITKLFDDPSQSSELLSEAKKLNDSQAPK

SEQ ID NO: 1501 - protein, 58 aa, ARTIFICIAL SEQUENCE
  Engineered IL6 binding polypeptide
VDAKYAKEEFEAWFEIHKLPNLTVEQMAAFITKLFDDPSQSSELLSEAKKLNDSQAPK

SEQ ID NO: 1502 - protein, 58 aa, ARTIFICIAL SEQUENCE
  Engineered IL6 binding polypeptide
VDAKYAKEESQAWTEIHLLPNLTIEQMAAFISKLFDDPSQSSELLSEAKKLNDSQAPK

SEQ ID NO: 1503 - protein, 58 aa, ARTIFICIAL SEQUENCE
  Engineered IL6 binding polypeptide
VDAKYAKEERKAWFEIHLLPNLTTQQRSAFISKLFDDPSQSSELLSEAKKLNDSQAPK

SEQ ID NO: 1504 - protein, 58 aa, ARTIFICIAL SEQUENCE
  Engineered IL6 binding polypeptide
VDAKYAKEERSAWFEIHTLPNLTVQQIAAFIWKLYDDPSQSSELLSEAKKLNDSQAPK

SEQ ID NO: 1505 - protein, 58 aa, ARTIFICIAL SEQUENCE
  Engineered IL6 binding polypeptide
VDAKYAKEERQAWWEIHSLPNLTVDQMAAFIVKLMDDPSQSSELLSEAKKLNDSQAPK

SEQ ID NO: 1506 - protein, 58 aa, ARTIFICIAL SEQUENCE
  Engineered IL6 binding polypeptide
VDAKYAKEQAKAWWEIHVLPNLTVHQVAAFITKLFDDPSQSSELLSEAKKLNDSQAPK

SEQ ID NO: 1507 - protein, 58 aa, ARTIFICIAL SEQUENCE
  Engineered IL6 binding polypeptide
VDAKYAKEERDAWHEIQILPNLTITQMAAFISKLFDDPSQSSELLSEAKKLNDSQAPK

SEQ ID NO: 1508 - protein, 58 aa, ARTIFICIAL SEQUENCE
  Engineered IL6 binding polypeptide
VDAKYAKEEQRAWTEIHVLPNLTVQQMAAFITKLFDDPSQSSELLSEAKKLNDSQAPK

SEQ ID NO: 1509 - protein, 58 aa, ARTIFICIAL SEQUENCE
  Engineered IL6 binding polypeptide
VDAKYAKETQHAWWEIHKLPNLTVSQMAAFITKLFDDPSQSSELLSEAKKLNDSQAPK

SEQ ID NO: 1510 - protein, 58 aa, ARTIFICIAL SEQUENCE
  Engineered IL6 binding polypeptide
VDAKYAKEDRTAWWEIHKLPNLTAEQMAAFITKLFDDPSQSSELLSEAKKLNDSQAPK

SEQ ID NO: 1511 - protein, 58 aa, ARTIFICIAL SEQUENCE
  Engineered IL6 binding polypeptide
VDAKYAKEERDAWREIHALPNLTVDQLVAFITKLFDDPSQSSELLSEAKKLNDSQAPK

SEQ ID NO: 1512 - protein, 58 aa, ARTIFICIAL SEQUENCE
  Engineered IL6 binding polypeptide
VDAKYAKEEQRAWREIHLLPNLTIEQMAAFIWKLLDDPSQSSELLSEAKKLNDSQAPK

SEQ ID NO: 1513 - protein, 58 aa, ARTIFICIAL SEQUENCE
  Engineered IL6 binding polypeptide
VDAKYAKEEQRAWTEIHVLPNLTVSQMSAFISKLFDDPSQSSELLSEAKKLNDSQAPK

SEQ ID NO: 1514 - protein, 58 aa, ARTIFICIAL SEQUENCE
  Engineered IL6 binding polypeptide
VDAKYAKEQHQAWNEIHLLPNLTVNQMAAFIVKLFDDPSQSSELLSEAKKLNDSQAPK

SEQ ID NO: 1515 - protein, 58 aa, ARTIFICIAL SEQUENCE
  Engineered IL6 binding polypeptide
VDAKYAKEEHAAWLEIHLLPNLTVKQMAAFIGKLMDDPSQSSELLSEAKKLNDSQAPK

SEQ ID NO: 1516 - protein, 58 aa, ARTIFICIAL SEQUENCE
  Engineered IL6 binding polypeptide
VDAKYAKEEQMAWFEIHLLPNLTVGQMAAFIQKLFDDPSQSSELLSEAKKLNDSQAPK

SEQ ID NO: 1517 - protein, 58 aa, ARTIFICIAL SEQUENCE
  Engineered IL6 binding polypeptide
VDAKYAKEERSAWFEIHILPNLTISQKSAFIVKLFDDPSQSSELLSEAKKLNDSQAPK

SEQ ID NO: 1518 - protein, 58 aa, ARTIFICIAL SEQUENCE
  Engineered IL6 binding polypeptide
VDAKYAKEERSAWYEIHLLPNLTADQMAAFIAKLFDDPSQSSELLSEAKKLNDSQAPK

SEQ ID NO: 1519 - protein, 58 aa, ARTIFICIAL SEQUENCE
  Engineered IL6 binding polypeptide
VDAKYAKEEQRAWYEIHLLPNLTIEQLTAFIMKLMDDPSQSSELLSEAKKLNDSQAPK

SEQ ID NO: 1520 - protein, 58 aa, ARTIFICIAL SEQUENCE
  Engineered IL6 binding polypeptide
VDAKYAKEERQAWWEITILPNLTIEQVAAFITKLFDDPSQSSELLSEAKKLNDSQAPK

SEQ ID NO: 1521 - protein, 58 aa, ARTIFICIAL SEQUENCE
  Engineered IL6 binding polypeptide
VDAKYAKEDYEAWVEIHVLPNLTVEQKAAFIVKLFDDPSQSSELLSEAKKLNDSQAPK

SEQ ID NO: 1522 - protein, 58 aa, ARTIFICIAL SEQUENCE
  Engineered IL6 binding polypeptide
VDAKYAKEVYNAWHEIHVLPNLTTLQISAFISKLFDDPSQSSELLSEAKKLNDSQAPK

SEQ ID NO: 1523 - protein, 58 aa, ARTIFICIAL SEQUENCE
  Engineered IL6 binding polypeptide
VDAKYAKEERKAWWEIHLLPNLTVRQTAAFIWKLLDDPSQSSELLSEAKKLNDSQAPK

SEQ ID NO: 1524 - protein, 58 aa, ARTIFICIAL SEQUENCE
  Engineered IL6 binding polypeptide
VDAKYAKEEQAAWWEIHMLPNLTIEQRTAFIIKLFDDPSQSSELLSEAKKLNDSQAPK

SEQ ID NO: 1525 - protein, 58 aa, ARTIFICIAL SEQUENCE
  Engineered IL6 binding polypeptide
VDAKYAKEEQTAWFEIHILPNLTVNQRVAFITKLFDDPSQSSELLSEAKKLNDSQAPK

SEQ ID NO: 1526 - protein, 58 aa, ARTIFICIAL SEQUENCE
  Engineered IL6 binding polypeptide
VDAKYAKEEALAWREIHLLPNLTTVQISAFIAKLLDDPSQSSELLSEAKKLNDSQAPK

SEQ ID NO: 1527 - protein, 58 aa, ARTIFICIAL SEQUENCE
  Engineered IL6 binding polypeptide
VDAKYAKEEKFAWTEIHLLPNLTIGQQAAFIWKLFDDPSQSSELLSEAKKLNDSQAPK

SEQ ID NO: 1528 - protein, 58 aa, ARTIFICIAL SEQUENCE
  Engineered IL6 binding polypeptide
VDAKYAKEERAAWWEIHVLPNLTVSQMYAFITKLFDDPSQSSELLSEAKKLNDSQAPK

SEQ ID NO: 1529 - protein, 58 aa, ARTIFICIAL SEQUENCE
  Engineered IL6 binding polypeptide
VDAKYAKEEQRAWYEIHLLPNLTVRQRGAFITKLFDDPSQSSELLSEAKKLNDSQAPK

SEQ ID NO: 1530 - protein, 58 aa, ARTIFICIAL SEQUENCE
  Engineered IL6 binding polypeptide
VDAKYAKEHRQAWMEIHLLPNLTIRQIAAFIAKLFDDPSQSSELLSEAKKLNDSQAPK

SEQ ID NO: 1531 - protein, 58 aa, ARTIFICIAL SEQUENCE
  Engineered IL6 binding polypeptide
VDAKYAKEEKVAWHEIHVLPNLTVSQISAFITKLFDDPSQSSELLSEAKKLNDSQAPK

SEQ ID NO: 1532 - protein, 58 aa, ARTIFICIAL SEQUENCE
  Engineered IL6 binding polypeptide
VDAKYAKEEKHAWYEIHLLPNLTISQLSAFIMKLFDDPSQSSELLSEAKKLNDSQAPK

SEQ ID NO: 1533 - protein, 58 aa, ARTIFICIAL SEQUENCE
  Engineered IL6 binding polypeptide
VDAKYAKESAFAWWEIHLLPNLTVEQIAAFIWKLLDDPSQSSELLSEAKKLNDSQAPK

SEQ ID NO: 1534 - protein, 58 aa, ARTIFICIAL SEQUENCE
  Engineered IL6 binding polypeptide
VDAKYAKEEQVAWREIHVLPNLTVEQVKAFINKLFDDPSQSSELLSEAKKLNDSQAPK

SEQ ID NO: 1535 - protein, 58 aa, ARTIFICIAL SEQUENCE
  Engineered IL6 binding polypeptide
VDAKYAKEEMDAWTEIHILPNLTVEQMEAFIVKLFDDPSQSSELLSEAKKLNDSQAPK

SEQ ID NO: 1536 - protein, 58 aa, ARTIFICIAL SEQUENCE
  Engineered IL6 binding polypeptide
VDAKYAKEEGRAWYEIHALPNLTVEQMSAFIIKLFDDPSQSSELLSEAKKLNDSQAPK

SEQ ID NO: 1537 - protein, 58 aa, ARTIFICIAL SEQUENCE
  Engineered IL6 binding polypeptide
VDAKYAKEERNAWFEIHILPNLTLSQITAFIWKLLDDPSQSSELLSEAKKLNDSQAPK

SEQ ID NO: 1538 - protein, 58 aa, ARTIFICIAL SEQUENCE
  Engineered IL6 binding polypeptide
VDAKYAKEEHNAWTEIHRLPNLTVKQTSAFIEKLFDDPSQSSELLSEAKKLNDSQAPK

SEQ ID NO: 1539 - protein, 58 aa, ARTIFICIAL SEQUENCE
  Engineered IL6 binding polypeptide
VDAKYAKEEFKAWWEIHVLPNLTADQVAAFIVKLFDDPSQSSELLSEAKKLNDSQAPK

SEQ ID NO: 1540 - protein, 58 aa, ARTIFICIAL SEQUENCE
  Engineered IL6 binding polypeptide
VDAKYAKEQHMAWTEIHLLPNLTVAQMAAFIVKLFDDPSQSSELLSEAKKLNDSQAPK

SEQ ID NO: 1541 - protein, 58 aa, ARTIFICIAL SEQUENCE
  Engineered IL6 binding polypeptide
VDAKYAKEEQRAWWEIHLLPNLTARQTAAFIWKLMDDPSQSSELLSEAKKLNDSQAPK

SEQ ID NO: 1542 - protein, 58 aa, ARTIFICIAL SEQUENCE
  Engineered IL6 binding polypeptide
VDAKYAKEQKSAWTEIHLLPNLTVHQISAFIAKLLDDPSQSSELLSEAKKLNDSQAPK

SEQ ID NO: 1543 - protein, 58 aa, ARTIFICIAL SEQUENCE
  Engineered IL6 binding polypeptide
VDAKYAKEEHLAWKEIHKLPNLTVIQMAAFITKLFDDPSQSSELLSEAKKLNDSQAPK

SEQ ID NO: 1544 - protein, 58 aa, ARTIFICIAL SEQUENCE
  Engineered IL6 binding polypeptide
VDAKYAKEERAAWWEIHMLPNLTADQMAAFIAKLFDDPSQSSELLSEAKKLNDSQAPK

SEQ ID NO: 1545 - protein, 58 aa, ARTIFICIAL SEQUENCE
  Engineered IL6 binding polypeptide
VDAKYAKEQRTAWWEIHILPNLTVKQLVAFINKLFDDPSQSSELLSEAKKLNDSQAPK

SEQ ID NO: 1546 - protein, 58 aa, ARTIFICIAL SEQUENCE
  Engineered IL6 binding polypeptide
VDAKYAKEEQIAWFEIHLLPNLTVGQRTAFIVKLFDDPSQSSELLSEAKKLNDSQAPK

SEQ ID NO: 1547 - protein, 58 aa, ARTIFICIAL SEQUENCE
  Engineered IL6 binding polypeptide
VDAKYAKEERRAWFEISVLPNLTVDQTAAFIMKLFDDPSQSSELLSEAKKLNDSQAPK

SEQ ID NO: 1548 - protein, 58 aa, ARTIFICIAL SEQUENCE
  Engineered IL6 binding polypeptide
VDAKYAKEEADAWMEIHILPNLTVLQRSAFIIKLFDDPSQSSELLSEAKKLNDSQAPK

SEQ ID NO: 1549 - protein, 58 aa, ARTIFICIAL SEQUENCE
  Engineered IL6 binding polypeptide
VDAKYAKEEREAWFEIHVLPNLTIKQISAFIHKLFDDPSQSSELLSEAKKLNDSQAPK

SEQ ID NO: 1550 - protein, 58 aa, ARTIFICIAL SEQUENCE
  Engineered IL6 binding polypeptide
VDAKYAKEERRAWFEIHTLPNLTVEQIEAFINKLFDDPSQSSELLSEAKKLNDSQAPK

SEQ ID NO: 1551 - protein, 58 aa, ARTIFICIAL SEQUENCE
  Engineered IL6 binding polypeptide
VDAKYAKEERAAWWEIHGLPNLTVWQTAAFIVKLFDDPSQSSELLSEAKKLNDSQAPK

SEQ ID NO: 1552 - protein, 58 aa, ARTIFICIAL SEQUENCE
  Engineered Z variant
AEAKYAKELGWATWEIFNLPNLTGVQVKAFIDKLRDDPSQSSELLSEAKKLNDSQAPK

SEQ ID NO: 1553 - protein, 58 aa, ARTIFICIAL SEQUENCE
  Engineered Z variant
VDAKYAKELGWATWEIFNLPNLTGVQVKAFIDKLRDDPSQSSELLSEAKKLNDSQAPK

SEQ ID NO: 1554 - protein, 46 aa, ARTIFICIAL SEQUENCE
  Engineered albumin binding polypeptide
LAEAKEAANAELDSYGVSDFYKRLIDKAKTVEGVEALKDAILAALP

SEQ ID NO: 1555 - protein, 184 aa, HOMO SAPIENS
PVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 1556 - protein, 188 aa, MUS MUSCULUS
MFPTSQVRRGDFTEDTTPNRPVYTTSQVGGLITHVLWEIVEMRKELCNGNSDCMNNDDALAENNLKLPEIQRNDGCYQTGYNQEICLLKISSGLLEYHSYLEYMKNNLKDNKKDKARVLQRDTETLIHIFNQEVKDLHKIVLPTPISNALLTDKLESQKEWLRTKTIQFILKSLEEFLKVTLRSTRQT

SEQ ID NO: 1557 - DNA, 24 bp, ARTIFICIAL SEQUENCE
  PCR primer
tgcttccggctcgtatgttgtgtg

SEQ ID NO: 1558 - DNA, 21 bp, ARTIFICIAL SEQUENCE
  PCR primer
cggaaccagagccaccaccgg

SEQ ID NO: 1559 - DNA, 21 bp, ARTIFICIAL SEQUENCE
  Sequencing primer
cggaaccagagccaccaccgg

SEQ ID NO: 1560 - DNA, 147 bp, ARTIFICIAL SEQUENCE
  Library oligonucleotide
  misc_feature (39)..(47): n is a, c, g, or t
  misc_feature (54)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnngcgtggnnngagatcnnnnnnctgcctaacctcaccnnnnnncaannnnnngccttcatcnnnaaattannngatgacccaagccagagctcattattta

SEQ ID NO: 1561 - DNA, 147 bp, Artificial Sequence
  Library oligonucleotide
  misc_feature (39)..(47): n is a, c, g, or t
  misc_feature (51)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnngctnnnnnngagatcnnnnnnctgccgaacctgaccnnnnnncagnnnnnngccttcatcnnnaaattannngatgacccaagccagagctcattattta

SEQ ID NO: 1562 - protein, 29 aa, Artificial Sequence
  Engineered IL6 binding polypeptide
  MISC_FEATURE (3)..(3): Xaa is selected from A, F, H, K, Q, R, S, W and Y
  MISC_FEATURE (4)..(4): Xaa is selected from A, D, E, F, H, I, K, L, M, N, Q, R, S, T, V and Y
  MISC_FEATURE (7)..(7): Xaa is selected from F, H, I, K, L, M, N, R, S, T, V, W and Y
  MISC_FEATURE (11)..(11): Xaa is selected from A, I, K, L, M, N, R, S, T and V
  MISC_FEATURE (16)..(16): Xaa is selected from N and T
  MISC_FEATURE (17)..(17): Xaa can be selected from A, I, T and V
  MISC_FEATURE (18)..(18): Xaa is selected from D, E, G, H, K, N, Q, R, S and T
  MISC_FEATURE (20)..(20): Xaa is selected from I, L, M, R, T and V
  MISC_FEATURE (21)..(21): Xaa is selected from A, S, T and V
  MISC_FEATURE (25)..(25): Xaa is selected from I, M, Q, S, T, V and W
  MISC_FEATURE (26)..(26): Xaa is selected from K and S
  MISC_FEATURE (28)..(28): Xaa is selected from F, L, M and Y
  MISC_FEATURE (29)..(29): Xaa is selected from D and R
EEXXAWXEIHXLPNLXXXQXXAFIXXLXX

SEQ ID NO: 1563 - protein, 20 aa, Artificial Sequence
  Engineered IL6 binding polypeptide
  MISC_FEATURE (1)..(2): [BM] is an IL-6 binding motif
  MISC_FEATURE (7)..(7): Xaa is selected from A and S
  MISC_FEATURE (8)..(8): Xaa is selected from N and E
  MISC_FEATURE (11)..(11): Xaa is selected from A, S and C
  MISC_FEATURE (17)..(17): Xaa is selected from E, N and S
  MISC_FEATURE (18)..(18): Xaa is selected from D, E and S
  MISC_FEATURE (19)..(19): Xaa is selected from A and S
KDPSQSXXLLXEAKKLXXXQ

SEQ ID NO: 1564 - protein, 20 aa, Artificial Sequence
  Engineered IL6 binding polypeptide
  MISC_FEATURE (1)..(2): [BM] is an IL-6 binding motif
  MISC_FEATURE (7)..(7): Xaa is selected from A and S
  MISC_FEATURE (8)..(8): Xaa is selected from N and E
  MISC_FEATURE (11)..(11): Xaa is selected from A, S and C
  MISC_FEATURE (17)..(17): Xaa is selected from E, N and S
  MISC_FEATURE (18)..(18): Xaa is selected from D, E and S
  MISC_FEATURE (19)..(19): Xaa is selected from A and S
KQPEQSXXLLXEAKKLXXXQ

SEQ ID NO: 1565 - protein, 29 aa, Artificial Sequence
  Engineered IL6 binding polypeptide
  MISC_FEATURE (7)..(8): [BM] is an IL-6 binding motif
ADNNFNKDPSQSANLLSEAKKLNESQAPK

SEQ ID NO: 1566 - protein, 29 aa, Artificial Sequence
  Engineered IL6 binding polypeptide
  MISC_FEATURE (7)..(8): [BM] is an IL-6 binding motif
ADNKFNKDPSQSANLLAEAKKLNDAQAPK

SEQ ID NO: 1567 - protein, 29 aa, Artificial Sequence
  Engineered IL6 binding polypeptide
  MISC_FEATURE (7)..(8): [BM] is an IL-6 binding motif
ADNKFNKDPSVSKEILAEAKKLNDAQAPK

SEQ ID NO: 1568 - protein, 32 aa, Artificial Sequence
  Engineered IL6 binding polypeptide
  MISC_FEATURE (10)..(11): [BM] is an IL-6 binding motif
ADAQQNNFNKDPSQSTNVLGEAKKLNESQAPK

SEQ ID NO: 1569 - protein, 27 aa, Artificial Sequence
  Engineered IL6 binding polypeptide
  MISC_FEATURE (5)..(6): [BM] is an IL-6 binding motif
AQHDEDPSQSANVLGEAQKLNDSQAPK

SEQ ID NO: 1570 - protein, 29 aa, Artificial Sequence
  Engineered IL6 binding polypeptide
  MISC_FEATURE (7)..(8): [BM] is an IL-6 binding motif
VDNKFNKDPSQSANLLAEAKKLNDAQAPK

SEQ ID NO: 1571 - protein, 29 aa, Artificial Sequence
  Engineered IL6 binding polypeptide
  MISC_FEATURE (7)..(8): [BM] is an IL-6 binding motif
AEAKYAKDPSESSELLSEAKKLNKSQAPK

SEQ ID NO: 1572 - protein, 29 aa, Artificial Sequence
  Engineered IL6 binding polypeptide
  MISC_FEATURE (7)..(8): [BM] is an IL-6 binding motif
VDAKYAKDPSQSSELLAEAKKLNDAQAPK

SEQ ID NO: 1573 - protein, 29 aa, Artificial Sequence
  Engineered IL6 binding polypeptide
  MISC_FEATIURE (7)..(8): [BM] is an IL-6 binding motif
VDAKYAKDPSQSSELLAEAKKLNDSQAPK

SEQ ID NO: 1574 - protein, 29 aa, Artificial Sequence
  Engineered IL6 binding polypeptide
  MISC_FEATURE (7)..(8): [BM] is an IL-6 binding motif
AEAKYAKDPSQSSELLSEAKKLNDSQAPK

SEQ ID NO: 1575 - protein, 29 aa, Artificial Sequence
  Engineered IL6 binding polypeptide
  MISC_FEATURE (7)..(8): [BM] is an IL-6 binding motif
AEAKYAKDPSQSSELLSEAKKLSESQAPK

SEQ ID NO: 1576 - protein, 29 aa, Artificial Sequence
  Engineered IL6 binding polypeptide
  MISC_FEATURE (7)..(8): [BM] is an IL-6 binding motif
AEAKYAKQPEQSSELLSEAKKLSESQAPK

SEQ ID NO: 1577 - protein, 29 aa, Artificial Sequence
  Engineered IL6 binding polypeptide
  MISC_FEATURE (7)..(8): [BM] is an IL-6 binding motif
AEAKYAKDPSQSSELLSEAKKLESSQAPK

SEQ ID NO: 1578 - protein, 29 aa, Artificial Sequence
  Engineered IL6 binding polypeptide
  MISC_FEATURE (7)..(8): [BM] is an IL-6 binding motif
AEAKYAKQPEQSSELLSEAKKLESSQAPK

SEQ ID NO: 1579 - protein, 29 aa, Artificial Sequence
  Engineered IL6 binding polypeptide
  MISC_FEATURE (7)..(8): [BM] is an IL-6 binding motif
VDAKYAKDPSQSSELLSEAKKLNDSQAPK

SEQ ID NO: 1580 - protein, 29 aa, Artificial Sequence
  Engineered IL6 binding polypeptide
  MISC_FEATURE (7)..(8): [BM] is an IL-6 binding motif
VDAKYAKDPSQSSELLSEAKKLSESQAPK

SEQ ID NO: 1581 - protein, 29 aa, Artificial Sequence
  Engineered IL6 binding polypeptide
  MISC_FEATURE (7)..(8): [BM] is an IL-6 binding motif
VDAKYAKQPEQSSELLSEAKKLSESQAPK

SEQ ID NO: 1582 - protein, 29 aa, Artificial Sequence
  Engineered IL6 binding polypeptide
  MISC_FEATURE (7)..(8): [BM] is an IL-6 binding motif
VDAKYAKDPSQSSELLSEAKKLESSQAPK

SEQ ID NO: 1583 - protein, 29 aa, Artificial Sequence
  Engineered IL6 binding polypeptide
  MISC_FEATURE (7)..(8): [BM] is an IL-6 binding motif
VDAKYAKQPEQSSELLSEAKKLESSQAPK

SEQ ID NO: 1584 - protein, 29 aa, Artificial Sequence
  Engineered IL6 binding polypeptide
  MISC_FEATURE (7)..(8): [BM] is an IL-6 binding motif
VDAKYAKDPSQSSELLAEAKKLNKAQAPK

SEQ ID NO: 1585 - protein, 29 aa, Artificial Sequence
  Engineered IL6 binding polypeptide
  MISC_FEATURE (7)..(8): [BM] is an IL-6 binding motif
AEAKYAKDPSQSSELLAEAKKLNKAQAPK

SEQ ID NO: 1586 - protein, 29 aa, Artificial Sequence
  Engineered IL6 binding polypeptide
  MISC_FEATURE (7)..(8): [BM] is an IL-6 binding motif
VDAKYAKDPSQSSELLSEAKKLNDSQAPK

SEQ ID NO: 1587 - protein, 29 aa, Artificial Sequence
  Engineered IL6 binding polypeptide
  MISC_FEATURE (7)..(8): wherein [BM] is an IL-6 binding motif
AEAKYAKDPSQSSELLSEAKKLNDSQAPK

SEQ ID NO: 1588 - protein, 6 aa, Artificial Sequence
  HIS-GLU Tag
HEHEHE

SEQ ID NO: 1589 - protein, 5 aa, Artificial Sequence
  Artificial Linker
GGGGS

SEQ ID NO: 1590 - protein, 18 aa, Artificial Sequence
  Artificial Linker
KESGSVSSEQLAQFRSLD

SEQ ID NO: 1591 - protein, 13 aa, Artificial Sequence
  Artificial Linker
EGKSSGSGSEKST

SEQ ID NO: 1592 - protein, 12 aa, Artificial Sequence
  Artificial Linker
GSAGSAAGSGEF

SEQ ID NO: 1593 - protein, 4 aa, Artificial Sequence
  Artificial Linker
VDGS

SEQ ID NO: 1594 - protein, 4 aa, Artificial Sequence
  Artificial Linker
ASGS

SEQ ID NO: 1595 - protein, 14 aa, Artificial Sequence
  Engineered IL6 binding polypeptide
  MISC_FEATURE (12)..(13): Z Variant
MGSSHHHHHHLQVD

The invention claimed is:

1. An interleukin-6 (IL-6) binding polypeptide, comprising an IL-6 binding motif (BM), which motif consists of the amino acid sequence selected from:

$$\text{i) } EEX_3X_4AWX_7EIHX_{11}LPNLX_{16}X_{17}X_{18}QX_{20}X_{21}AFIX_{25}X_{26}LX_{28}X_{29} \quad \text{(SEQ ID NO: 1562)}$$

wherein, independently from each other,
$X_3$ is selected from A, F, H, K, Q, R, S, W and Y;
$X_4$ is selected from A, D, E, F, H, I, K, L, M, N, Q, R, S, T, V and Y;
$X_7$ is selected from F, H, I, K, L, M, N, R, S, T, V, W and Y;
$X_{11}$ is selected from A, I, K, L, M, N, R, S, T and V;
$X_{16}$ is selected from N and T;
$X_{17}$ is selected from A, I, T and V;
$X_{18}$ is selected from D, E, G, H, K, N, Q, R, S and T;
$X_{20}$ is selected from I, L, M, R, T and V;
$X_{21}$ is selected from A, S, T and V;
$X_{25}$ is selected from I, M, Q, S, T, V and W;
$X_{26}$ is selected from K and S;
$X_{28}$ is selected from F, L, M and Y; and
$X_{29}$ is selected from D and R;

and
ii) an amino acid sequence which has at least 93% identity to the full-length sequence defined in i).

2. The IL-6 binding polypeptide according to claim 1, wherein sequence i) is the sequence from position 8 to position 36 in a sequence selected from the group consisting of SEQ ID NO:1-1551.

3. The IL-6 binding polypeptide according to claim 1, wherein said IL-6 binding motif forms part of a three-helix bundle protein domain.

4. The IL-6 binding polypeptide according to claim 1, which comprises a binding module BMod, the amino acid sequence of which is selected from:

$$\text{iii) } K\text{-}[BM]\text{-}DPSQSX_aX_bLLX_cEAKKLX_dX_eX_fQ; \quad \text{(SEQ ID NO: 1563)}$$

wherein
[BM] is an IL-6 binding motif as defined in claim 1 provided that $X_{29}$ is D;
$X_a$ is selected from A and S;
$X_b$ is selected from N and E;
$X_c$ is selected from A, S and C;
$X_d$ is selected from E, N and S;
$X_e$ is selected from D, E and S;

$X_f$ is selected from A and S; and iv) an amino acid sequence which has at least 95% identity to the full length sequence defined by iii).

5. The IL-6 binding polypeptide according to claim 1, which comprises the amino acid sequence selected from:

```
                                    (SEQ ID NO: 1586)
xi) VDAKYAK-[BM]-DPSQSSELLSEAKKLNDSQAPK;
``` wherein [BM] is an IL-6 binding motif as defined in claim 1; and xii) an amino acid sequence which has at least 96% identity to the full length sequence defined in xi).

6. The IL-6 binding polypeptide according to claim 5, wherein sequence xi) is selected from the group consisting of SEQ ID NO:1-1551.

7. The IL-6 binding polypeptide according to claim 1, which is capable of blocking the IL-6 dependent signaling via the cis-signaling pathway and/or the trans-signaling pathway.

8. The IL-6 binding polypeptide according to claim 7, wherein the half maximal inhibitory concentration of the blocking is at most $1 \times 10^{-6}$ M.

9. The IL-6 binding polypeptide according to claim 7, which is capable of blocking the interaction of IL-6/IL-6Rα with gp130.

10. The IL-6 binding polypeptide according to claim 1, which is capable of binding to IL-6 such that the EC50 value of the interaction is at most $1 \times 10^{-7}$ M or such that the $K_D$ value of the interaction is at most $1 \times 10^{-8}$ M.

11. A composition comprising the IL-6 binding polypeptide according to claim 1 and at least one pharmaceutically acceptable excipient or carrier.

12. The IL-6 binding polypeptide according to claim 1, wherein said IL-6 binding polypeptide modulates IL-6 function in vivo.

13. The IL-6 binding polypeptide according to claim 2, wherein sequence i) is the sequence from position 8 to position 36 in a sequence selected from the group consisting of SEQ ID NO:1-14 and SEQ ID NO:1512.

14. The IL-6 binding polypeptide according to claim 13, wherein sequence i) is the sequence from position 8 to position 36 in SEQ ID NO:1512.

15. A fusion protein or conjugate comprising
a first moiety consisting of the IL-6 binding polypeptide according to claim 1; and
a second moiety consisting of a polypeptide having a desired biological activity.

16. A polynucleotide encoding the IL-6 binding polypeptide according to claim 1.

17. A method of detecting IL-6, comprising
contacting a sample suspected to contain IL-6 with the IL-6 binding polypeptide according to claim 1, and
detecting the binding of the IL-6 binding polypeptide to IL-6 to indicate the presence of IL-6 in the sample.

18. A method of treatment of an IL-6 related disorder, comprising administering the IL-6 binding polypeptide according to claim 1 to a subject in need of treatment of an IL-6 related disorder that receives benefit from at least partial blocking of IL-6 signaling, wherein the IL-6 related disorder is rheumatoid arthritis, juvenile rheumatoid arthritis, juvenile idiopathic arthritis, systemic juvenile idiopathic arthritis, vasculitis, psoriatic arthritis, psoriasis, a chronic inflammatory bowel disease, Crohn's disease, ulcerative colitis, Grave's disease, Behçet's disease, uveitis, giant cell arteritis, multiple sclerosis, systemic sclerosis, systemic lupus erythematosus, polymyositis, polymyalgia rheumatic, relapsing polychondritis, pancreatitis, peritonitis, nephritis, Sjögren's syndrome, adult Still's disease, or Castleman's disease.

19. The method of claim 18, wherein the blocking is of the cis- or the trans-signaling pathway.

20. The method of claim 18, wherein the IL-6 binding polypeptide blocks the interaction of IL-6/IL-6Rα with gp130.

* * * * *